United States Patent
O'Shea et al.

(10) Patent No.: US 10,577,589 B2
(45) Date of Patent: *Mar. 3, 2020

(54) ADENOVIRAL ASSEMBLY METHOD

(71) Applicant: Salk Institute for Biological Studies, La Jolla, CA (US)

(72) Inventors: Clodagh O'Shea, La Jolla, CA (US); Colin Powers, La Jolla, CA (US)

(73) Assignee: Salk Institute for Biological Studies, La Jolla, CA (US)

( * ) Notice: Subject to any disclaimer, the term of this patent is extended or adjusted under 35 U.S.C. 154(b) by 194 days.

This patent is subject to a terminal disclaimer.

(21) Appl. No.: 14/935,866

(22) Filed: Nov. 9, 2015

(65) Prior Publication Data

US 2016/0053235 A1    Feb. 25, 2016

Related U.S. Application Data

(63) Continuation of application No. 13/769,025, filed on Feb. 15, 2013, now Pat. No. 9,217,160, which is a continuation of application No. PCT/US2011/048006, filed on Aug. 16, 2011.

(60) Provisional application No. 61/374,198, filed on Aug. 16, 2010.

(51) Int. Cl.
   *C12N 7/00* (2006.01)
   *C12N 15/861* (2006.01)
   *C12N 15/86* (2006.01)

(52) U.S. Cl.
   CPC ............... *C12N 7/00* (2013.01); *C12N 15/86* (2013.01); *C12N 15/861* (2013.01); *C12N 2710/10043* (2013.01); *C12N 2710/10051* (2013.01); *C12N 2710/10351* (2013.01); *C12N 2800/30* (2013.01); *C12N 2800/70* (2013.01)

(58) Field of Classification Search
   None
   See application file for complete search history.

(56) References Cited

U.S. PATENT DOCUMENTS

| | | | |
|---|---|---|---|
| 6,506,602 B1 | 1/2003 | Stemmer | |
| 6,838,285 B2 | 1/2005 | Farmer et al. | |
| 6,878,549 B1 | 4/2005 | Vogels et al. | |
| 7,045,347 B2 | 5/2006 | Graham et al. | |
| 7,252,989 B1 | 8/2007 | Zhang et al. | |
| 2003/0170899 A1* | 9/2003 | McVey | C12N 15/86 435/475 |
| 2004/0219516 A1 | 11/2004 | Bennett et al. | |
| 2006/0211115 A1 | 9/2006 | Roy et al. | |

(Continued)

FOREIGN PATENT DOCUMENTS

| | | |
|---|---|---|
| WO | WO 96/18418 | 6/1996 |
| WO | WO 00/03029 | 1/2000 |

(Continued)

OTHER PUBLICATIONS

Gibson et al. (2009) "Enzymatic assembly of DNA molecules up to several hundred kilobases" Nature Methods 6(5):343-345, including Supplemental figures and text.*

(Continued)

*Primary Examiner* — Karen S. Weiler
(74) *Attorney, Agent, or Firm* — Klarquist Sparkman, LLP

(57) ABSTRACT

Methods of assembling modified adenoviruses, libraries of adenoviral gene modules and compositions thereof are provided herein.

15 Claims, 63 Drawing Sheets

Specification includes a Sequence Listing.

(56) References Cited

U.S. PATENT DOCUMENTS

2007/0292954 A1  12/2007  Elledge
2013/0231267 A1   9/2013  O'Shea et al.

FOREIGN PATENT DOCUMENTS

| WO | WO 02/46372    | 6/2002  |
|----|----------------|---------|
| WO | WO 03/076605   | 9/2003  |
| WO | WO 2005/001103 | 1/2005  |
| WO | WO 2007/124065 | 11/2007 |

OTHER PUBLICATIONS

Yount et al. (2010) "Strategy for Systematic Assembly of Large RNA and DNA Genomes: Transmissible Gastroenteritis Virus Model" Journal of Virology 74(22):10600-10611.*
Gall et al., "Construction and Characterization of Hexon-Chimeric Adenoviruses: Specification of Adenovirus Serotype," *J Virol* 72(12):10260-10264, 1998.
Roy et al., "Rescue of chimeric adenoviral vectors to expand the serotype repertoire," *J Virol Methods* 14:41-21, 2007.
Li and Elledge "Harnessing homologous recombination in vitro to generate recombinant DNA via SLIC," *Nat Methods* 4(3):251-256, 2007.
Alba et al., "Gutless adenovirus: last-generation adenovirus for gene therapy," *Gene Ther* 12:S18-S27, 2005.
Cheo et al., "Concerted Assembly and Cloning of Multiple DNA Segments Using In Vitro Site-Specific Recombination: Functional Analysis of Multi-Segment Expression Clones," *Genome Res* 14:2111-2120, 2004.

\* cited by examiner

FIG. 1

Comparison of Ad vector systems

| | ViraPower | AdEasy | Adsembly |
|---|---|---|---|
| Vector serotype | Ad5 only | Ad5 only | Any |
| Gateway compatible | Yes | No | Yes |
| Range of tags | No | No | Yes |
| Promoters available | CMV or no promoter | CMV | CMV & any promoter |
| Number of genes that can be expressed | 1 | 1 | Multi |
| Receptors / Cell tropism | CAR | CAR | CAR, CD46, endothelial, colon, kidney, etc |
| Receptor retargeting | No | No | Yes-BAP, Thiol, Ligand |
| Liver uptake | Yes | Yes | No, if hexon mutated |
| Flourescent marker for titering | No | No | Yes |
| Tag for purificaton | No | No | Yes |
| Bioreporter-PET, Lumninesence | No | No | Yes |
| cDNA and shRNA | No | No | Yes |
| Need to be linearized prior to transfection | Yes | Yes | No |
| Multiple injections | No | No | Yes-with capsid swap |
| Multi-gene expression | No | No | Yes |
| Maximum size for insertions | 7.5Kb | 7.5Kb | >10Kb |
| Special bacteria required | No | Yes | No |
| Can make replicating virus | No | No | Yes |
| Library of parts to choose from | No | No | Yes |

FIG. 4

Known receptors and tropism of human adenoviruses

| Subgroup | A | B1 | B2 | C | D | E | F | G |
|---|---|---|---|---|---|---|---|---|
| Serotype | 12, 18, 31 | 3, 7, 16, 21, 50 | 11, 14, 34, 35 | 1, 2, 5, 6 | 8-10, 13, 15, 17, 19, 20, 22-30, 32, 33, 36-39, 42-49, 51 | 4 | 40, 41 | 52 |
| Receptor(s) | CAR, αX, αX | CD46, αX, αX, CD80, CD86 | CD46, αX, αX, CD80, CD86 | CAR, αX, αX, α5, DPPC, VCAM-1, HS, MHC1-α2 | SA, CD46, αX | CAR | CAR | ND |
| Tropism | Intestinal crypts, Respiratory | Respiratory, Ocular | Kidneys, Respiratory, Ocular | Respiratory, Ocular, Lymphoid | Ocular, Enteric | Ocular, Respiratory | Enteric | Enteric |

Modified from Arnberg, N. *Rev. Med. Virol.* 2009; 19: 165-178

FIG. 7A

| | | |
|---|---|---|
| AAB05434 | 915 | NNRYASQIASFVLAWTRAFVSEWSQFLYENDAGIPLEKR-ILKSVYGDTDSL |
| AAB38716 | 916 | NNRYPSQIASFVLAWTRAFVSEWSQFLYENDAGTPLENR-VLKSVYGDTDSL |
| ACZ56364 | 904 | NNRYPSQIASFVLAWTRAFVSEWSQFLYADDVGIPLEDR-QLKSVYGDTDSL |
| ADD17102 | 908 | NNRYPSQIASFVLAWTRAFVSEWAQFLYADDAGIPLEKR-NLKSVYGDTDSL |
| AAC64523 | 876 | NKRYPTQLASFVLAWTRAFMSEWREILYSDEDSIPVQFK-TIKSIYGDTDSL |
| NP_047384 | 876 | NKRYPTQLASFVLAWTRAFMSEWREILYSDEDSIPVQFK-TIKSIYGDTDSL |
| ACW84422 | 872 | NKRYPTQLASFVLAWTRAFISEWAEILYHDENNIPIENK-SLKAIYGDTDSL |
| NP_062435 | 874 | NKRYPTQLASFVLSWTRAFMADWNAILYEKDSKS-ILVK-ELNAIYGDTDSL |
| AAR97559 | 972 | NKRYATQIACFVLGNSRAFFSEWCDILYGPDRGVHILRREEPRSLYGDTDSL |
| NP_043878 | 838 | NKRYATQIACFVLGNSRAFFSEWCDILYGPDRGVHILRREEPRSLYGDTDSL |
| AF083975_3 | 866 | NKRYATQIACFVLGNSRAFFSEWCEILHGPDRGTHLLQR-DPQTLYGDTDSL |
| NP_050281 | 866 | NKRYATQIACFVLGNSRAFFSEWCEILHGPDRGTHLLQR-DPQTLYGDTDSL |
| AAL89790 | 841 | NDRYATQVASFVLAWSRAFMSEWATILYGEDIGVPYEQR-KLKSVYGDTDSL |
| AF036092_20 | 832 | NNRYPTQIASFVLAWTRAFMSEWADILYGEDRGKSYSER-DLKSLYGDTDSL |
| U40839_2 | 830 | NNRYPTQIASFVLAWTRAFMSEWAEILYGEDMGKPYIER-EIKSIYGDTDSL |
| AP_000080 | 838 | NNRYPTQIASFVLAWTRAFTSEWASFLFEDDWGSNIENR-SLKVVYGDTDSL |
| CAA70801 | 838 | NNRYPTQIASFVLAWTRAFTSEWASFLFEDDWGSNIENR-SLKVVYGDTDSL |
| ACJ14508 | 971 | NDRYASHLASFVLAWTRGFMSEWSEILYESDRGIALERR-LNKSVYGDTDSL |
| AP_000342 | 983 | NDRYASHLASFVLAWTRGFMSEWSDILYESDRGLQLEKR-LIKSVYGDTDSL |
| AAD09719 | 792 | NNRYPSHIASFVLAWTRAFVSEWADILYLEDRGTPLEDR-ILKFVYGDTDSM |
| AP_000026 | 932 | NNRYPSHIASFVLAWTRAFVSEWADILYLEDRGTPLEDR-ILKFVYGDTDSM |
| AAS10360 | 960 | NDRYPSHVASFVLAWTRAFVSEWAGFLYDEDRGTPLEDR-PIKSVYGDTDSL |
| AAS10396 | 958 | NDRYPSHVASFVLAWTRAFVSEWAGFLYDEDRGTPLEDR-PIKSVYGDTDSL |
| AAS10432 | 958 | NDRYPSHVASFVLAWTRAFVSEWAGFLYDEDRGTPLEDR-PIKSVYGDTDSL |
| ABH01044 | 953 | NDRYPSQIASFVLAWTRAFVSEWSQFLYAEDLGTPLEDR-PLKSVYGDTDSL |
| YP_213966 | 953 | NDRYPSQIASFVLAWTRAFVSEWSQFLYAEDLGTPLEDR-PLKSVYGDTDSL |
| YP_067908 | 937 | NDRYPSHIASFVLAWTRAFMSEWCEFLYAEDRGTPLEER-ALTSVYGDTDSL |
| AAC16239 | 783 | NNRYASHIASFVLAWTRVFVSEWAEFLYAEDRGKPLHQR-TIKSVYGDTDSL |
| NP_064286 | 783 | NNRYASHIASFVLAWTRVFVSEWAEFLYAEDRGKPLHQR-TIKSVYGDTDSL |
| AP_000236 | 896 | NNRYASHLASFVLAWARVFVSEWSEFLYENDRGVPMEER-QIKSVYGDTDSL |
| YP_068060 | 902 | NDRYPSHIASFVLAWTRAFVSEWASFLYSEDLGTPMERR-CLKSVYGDTDSL |
| Ad5 Pol | 966 | NDRYPSHLASFVLAWTRAFVSEWSEFLYEEDRGTPLEDR-PLKSVYGDTDSL |
| | 1128 | N RYPSQIASFVLAWTRAFVSEWAEFLY EDRGTPLE R  LKSVYGDTDSL |

FIG. 7B

| | |
|---|---|
| AAB05434 | FTTMEGYRLMEEKGKRRLKKNGGNLVFDPNNPELTWLVECETKC |
| AAB38716 | FTTMEGYKLMEEKGKKRLKKNGGKLVFDPSNPELTWLVECETQC |
| ACZ56364 | FTTLEGYKLMETKGKHRLKKNGGKLVFDPSNPELTWLVECETQC |
| ADD17102 | FTTREGYRLMEEKGKKRLKKNGGKLVFDPDHPELTWLVECETQC |
| AAC64523 | FLTEKGHQNMLKYGQHRIKNKNSQLIFDPKKPSIVWAVECETWC |
| NP_047384 | FLTEKGHQNMLKYGQHRIKNKNSQLIFDPKKPSIVWAVECETWC |
| ACW84422 | FLTEAGHRLMLSKGNYRLKSDKTPLIFNPEAPKLTWAVECETEC |
| NP_062435 | FLTEKGHKRMIDHGQHRLKENVKSLVFQECCPDITWAVECETKC |
| AAR97559 | FVTETGYHRMKSRGAHRIKTESTRLIFDPENPGLYWACDCDIKC |
| NP_043878 | FVTETGYHRMKSRGAHRIKTESTRLTFDPENPGLYWACDCDIKC |
| AF083975_3 | FVTESGYRRMKERGAHRIKGPHTRLTFDPENPALYWACDCDIKC |
| NP_050281 | FVTESGYRRMKERGAHRIKGPHTRLTFDPENPALYWACDCDIKC |
| AAL89790 | FLTGEGHRLMITKGRHKLKSSGNSLVYRDDG-NLAWLVECETSC |
| AF036092_20 | FLSQKGHELMCSKGAHRLKHNNGKLVFDENEPQLQNLVECETVC |
| U40839_2 | FLTEKGHQLMLSKGLHRLKKYNSNLIFDEKHPCLTWLVECETVC |
| AP_000080 | FLTQHGHELMITKGKHRIKGYGTALIFDPHNPNLTWLVECETVC |
| CAA70801 | FLTQHGHELMITKGKHRIKGYGTALTFDPHNPNLTWLVECETVC |
| ACJ14508 | FVTEHGRILMETRGQHRLKKNGGKLVFNPNSPQLTWLVECETQC |
| AP_000342 | FVTEAGRNLMESRGKHRLKKNGGKLVFNPEKPSLTWLVECETQC |
| AAD09719 | FLTQRGKELMDTRGKHRLKGNNRPLVFDPTNPQLTWLVECETQC |
| AP_000026 | FLTQRGKELMDTRGKHRLKGNNRPLVFDPTNPQLTWLVECETQC |
| AAS10360 | FVTQRGHELMETRGKKRIKKHGGNLVFDPDRPDLTWLVECETVC |
| AAS10396 | FVTQRGHELMETRGKKRIKKHGGNLVFDPNRPDLTWLVECETVC |
| AAS10432 | FVTQRGHELMETRGKKRIKKHGGNLVFDPNRPDLTWLVECETVC |
| ABH01044 | FVTEAGHKLMETQGKKRIKKNGGNLVFDPAKPELTWLVECETVC |
| YP_213966 | FVTEAGHRLMETQGKKRIKKNGGNLVFDPAKPELTWLVECETVC |
| YP_067908 | FVTERGHRLMETRGRKRIKKNGGRLVFDPKDPQLTWLVECETVC |
| AAC16239 | FVTEEGHRLMEQRGKHRIKKNGGKLVFDPKNPSITWLVECETQC |
| NP_064286 | FVTEEGHRLMEQRGKHRIKKNGGKLVFDPKNPSITWLVECETQC |
| AP_000236 | FVTEEGHRLMKEKGKHRIKKNGGSLVFDPQHPQVTWLVECETRC |
| YP_068060 | FLTEEGRRLMETKGKHRIKKNGGKLVFDPANPDLTWLVECETQC |
| Ad5 Pol | FVTERGHRLMETRGKKRIKKHGGNLVFDPERPELTWLVECETVC |
| Consensus | FVTE GHRLMETRGKHRIKKNGG LVFDP  P LTWLVECET C |

FIG. 7C

```
AAB05434    EKCGADAYSSESVYLAPKLYALKDTTCP--ECQYVGKGKLRAKGH
AAB38716    EKCGSDAYSSESVYLAPKLYALKDTTCP--KCHHVGKGKLRAKGH
ACZ56364    EKCGSDAYSSESVYLAPKLYALKDTTCV--SCGHVGKGKLRAKGH
ADD17102    EKCGGDAYSTESVYLAPKLYALKNTVCT--RCGHVGKGKLRAKGH
AAC64523    NLCNSPAYSSKSIFLAPKLYALKEITCT--TCKNSKTGKLRAKGH
NP_047384   NLCNSPAYSSKSIFLAPKLYALKEITCT--TCKNSKTGKLRAKGH
ACW84422    NVCKKPGFCPDSIFLAPKLYALKKIFCP--SCNTEFGGKLRAKGH
NP_062435   PNCKSSAFSNRTIFLAPKLYALKRIVCN--SCNTETEGKLRAKGH
AAR97559    KACGSDTYSSETIFLAPKLYGLKNSICVNEQCRTVGPGKIRSKGH
NP_043878   KACGSDTYSSETIFLAPKLYGLKNSICVNEQCRTVGPGKIRSKGH
AF083975_3  KRCGGDTYSSEAIFLAPKLYGLKDAVCLDPECGHVGSGKIRSKGH
NP_050281   KRCGGDTYSSEAIFLAPKLYGLKDAVCLDPECGHVGSGKIRSKGH
AAL89790    PSCKSDSFSSESCFLAPKLYALKDTTCP--SCGLVSGGKLRAKGH
AF036092_20 EECHSVAFATESCFLAPKLYGLKEIKCT--KCNHIGSGKLRAKGH
U40839_2    NRCGAEAFSSETCILAPKLYALKDITCK--NCKFIGEGKLRAKGH
AP_000080   PLCKKIAYSTESVYLAPKLYGLKNIYCE--HCDVYSAGKLRAKGH
CAA70801    PLCKKIAYSTESVYLAPKLYGLKNIYCE--HCDVYSAGKLRAKGH
ACJ14508    KRCNSDAFSPRTIFLAPKLYALQKLICQ--NCGEEGPGKLRAKGH
AP_000342   KYCGSDAFSPRTVFLAPKLYALQKLVCP--TCGQEGAGKLRAKGH
AAD09719    PRCHGDAHSQESVFLAPKLYALKNIYCP--SCRREFWQTSSKGH
AP_000026   PRCHGDAHSQESVFLAPKLYALKNIYCP--SCRREFWQTSSKGH
AAS10360    ASCGADAYAPESVFLAPKLYALKSLLCP--VCGHTSKGKLRAKGH
AAS10396    ASCGADAYAPESVFLAPKLYALKSLLCP--VCGHTSKGKLRAKGH
AAS10432    ASCGADAYAPESVFLAPKLYALKSLLCP--VCGHTSKGKLRAKGH
ABH01044    AQCGADAYSPESVFLAPKLYALQCLHCT--KCQHVSKGKLRAKGH
YP_213966   AQCGADAYSPESVFLAPKLYALKCLHCT--KCQHVSKGKLRAKGH
YP_067908   SNCGGDAYSPESVFLAPKLYALKCLLCS--NCGHVSKGKLRAKGH
AAC16239    EKCKSDAFSSESVFLAPKLYALKNTVCT--CCGHVGKGKLRAKGH
NP_064286   EKCKSDAFSSESVFLAPKLYALKNTVCT--CCGHVGKGKLRAKGH
AP_000236   DKCGEDAYSPTSVFLAPKLYALKSTVCS--VCGYVGKGKLRAKGH
YP_068060   EKCGADAFSSQSIFLAPKLYALKDTTCP--VCKHVGKGKLRAKGH
Ad5 Pol     GACGADAYSPESVFLAPKLYALKSLHCP--SCGASSKGKLRAKGH
Consensus   CGSDAYSSESVFLAPKLYALK I C     C HVG GKLRAKGH
```

FIG. 7D

| ID | Pos | Sequence |
|---|---|---|
| AAA42509 | 463 | YEYMNGRIPVSGLIDTYVNIGTRWSPDVMDNVNPFNHHRNSGLRYRSQLLGNGRFCD |
| ABG22145 | 467 | YEYMNGRKPLQGFLDSYVNIGTRWSPDAMDNVNPFNHHRNAGLRYRSQLLGNGRYCD |
| YP_068069 | 459 | YAYMNGRVPANNLVDSFVNGARWSPDVMDNVNPFNHHRNAGLRYRSQLLGNGRYCR |
| AAB38725 | 453 | YAYMNVRLPAANLIDTFVNIGARWSPDVMDTVNPFNHHRNAGLRYRSQLLGNGRYCS |
| AP_000059 | 453 | YAYMNVRLPAANLIDTFVNIGARWSPDVMDSVNPFNHHRNAGLRYRSQLLGNGRYCS |
| ADD17111 | 456 | YAYMNIRLPAANLVDTFVNGARWSPDVMDTVNPFNHHRNAGLRYRSQLLGNGRYCS |
| AAB02183 | 485 | YDYINKRLPLNNLIDTFVNIGARWSPDVMDNVNPFNHHRNYGLRYRSQLLGNGRYCK |
| BAA76968 | 485 | YDYINKRLPLNNLIDTFVNIGARWSPDVMDNVNPFNHHRNYGLRYRSQLLGNGRYCK |
| AAF82136 | 462 | YDYMNIRIPPSGLVENYINIGARWSLDIMDNVNPFNHHRNAGLRYRSQLLGNGRYCE |
| ABG22140 | 457 | YAYMNGRIPAGGLVDTFVNIGARWSLDVMDNINPFNHHRNAGLRYRSQLLGNGRYCQ |
| ABG22147 | 457 | YAYMNGRVPAAGLVDTYVNIGARWSLDVMDNVNPFNHHRNAGLRYRSQLLGNGRYCH |
| ABG22141 | 459 | YEYLNGRIPAGGLVDTYVNIGARWSLDVMDTVNPFNHHRNAGLRYRSQLLGNGRYCQ |
| ABG22142 | 458 | YAYMNGRLPAGGLIDTYVNIGARWSPDVMDVVNPFNHHRNAGLRYRSQLLGNGRYCQ |
| ABG22148 | 458 | YAYMNGRLPAGGLIDTYVNIGARWSPDVMGRCKPIYHHRNAGLRYRSQLLGNGRYCQ |
| ACV96785 | 469 | YNYMNGRIPAAGLVDSFVNIGARWSPDVMDSVNPFNHHRNAGLRYRSQLLGNGRYCS |
| AAB48187 | 457 | YAYMNQRIAPAGLIETYVNVGGRWSVDFMDTVNPFNHHRNEGLKYRSQILGNGRFVD |
| ACJ14517 | 457 | YSYMNQRIAPTGLVETYVNMGGRWSVDFMDTVNPFNHHRNDGLKYRSQVLGNGRYVD |
| AAC41020 | 450 | YGYMNGRIPYPNVIDTWTNIGARWSLDIMDTINPFNHHRNTGLKYRSQLLGNGRFSR |
| AAF13265 | 449 | YGYINGRIPIPNVIDTWTNIGARWSLDVMDNINPFNHHRNGLRYRSQLLGNGRYCK |
| AAF20946 | 448 | YGYMNGRVPLANIIDTWTNIGARWSLDVMDTVNPFNHHRNSGLKYRSQLLGNGRYCR |
| AAL73247 | 442 | YGYINSRIPLPNIIDTWTNIGARWSLDVMDNINPFNHHRNMGLRYRSQLLGNGRYCK |
| CAA70809 | 451 | YAYMNGRLPLPNIIDTWTNIGARWSLDVMDEINPFNHHRNLGLKYRSQLLGNGRYCK |
| AAL92452 | 448 | YGYMNGRLPLPNIIDTWTDIGARWSLDVMDTVNPFNHHRNTGLKYRSQLLGNGRHCK |
| AAD51863 | 453 | YSYMNSRLPNVNMADLFTHIGGRYSLDVMDNVNPFNHHRNRGLQYRSQILGNGRNVR |
| NP_047393 | 453 | YSYMNSRLPNVNMADLFTHIGGRYSLDVMDNVNPFNHHRNRGLQYRSQILGNGRNVR |
| ACH89474 | 455 | YNYMNTRLPNVNVVDLFTNIGGRYSLDIMDNQNPFNHHKNRGLQYRSQILGNGRVCD |
| ACW84430 | 454 | YNYLNARLPHVNVVDLFTHLGGRYSLDVMDNQNPFNHHRNRGLQYRSQILGNARKVD |
| AAF86932 | 458 | YNYKNLRLPNVNLIDLFTQIGGRYSLSFMDNVNPFNHEKNRGLRYRSELLGNGRIAK |
| CAD42235 | 471 | YAYKNLHIPSQNIVDLFTNIGARYSIPQTDNVNPFNHHRNYGLNHRSMLLGNSRITN |
| AAC54912 | 471 | YFYMNRRVPLINVVDLFTNIGARWSVDQMDNVNPFNHHRNWGLKYRSQLLGNSRYCR |
| AP_000418 | 471 | YFYMNERVELINVVDLFTNIGARWSVDQMDNVNPFNHHRNWGLKYRSQLLGNSRYCR |
| NP_050287 | 477 | YEYMNRRVPLINVVDLFTTIGARWSIDQMDNVNPFNHHRNWGLKYRSQLLGNSRYCR |
| AAV90966 | 467 | YEYMNHRVPLVNVVDLFTNLGARWSVDQMDNVNPFNHHRNWGLKYRSQLLGNSRYCQ |
| AAR96457 | 512 | YDYMNRVVAPGLVDCYINLGARWSLDYMDNVNPFNHHRNAGLRYRSMLLGNGRYVP |
| AAX19408 | 480 | YGYMNGRVTPPGLVDTYVNVGARWSPDVMDSINPFNHHRNAGLRYRSMLLGNGRYVP |
| ABH01053 | 470 | YQYMNGRVTPPGLIDTYVNVGARWSPDVMDSINPFNHHRNAGLRYRSMLLGNGRYVP |
| AP_000275 | 505 | YDYMNGRVVPPSLVDTYVNIGARWSLDAMDNVNPFNHHRNAGLRYRSMLLGNGRYVP |
| CAA09917 | 498 | YDYMNGRVVPPSLVDTYVNIGARWSLDAMDNVNPFNHHRNAGLRYRSMLLGNGRYVP |
| AAT84627 | 481 | YGYINGRITAPGLIDTYVNIGARWSPDPMDNVNPFNHHRNAGLRYRSMLLGNGRVVP |
| AAB88060 | 451 | YDYMNGKLPAAGLIDSYVNVGSRWSLDVMDNINPFNHHRNAGLRYRSQILGNGRYCK |
| Ad5 hexon | 501 | YDYMNRVVAPGLVDCYINLGARWSLDYMDNVNPFNHHRNAGLRYRSMLLGNGRYVP |
|  | 555 | Y YMNGRLP NLVDTFVNIGARWSLDVMDNVNPFNHHRNAGLRYRSQLLGNGRYC |

FIG. 7E

```
AAA42509    FHIQVPQKFFAIRNLLLLPG-TYTYEWSFRKDVNMILQSTLGNDLRVDGATVNIT
ABG22145    FHIQVPQKFFAVRNLLLLPG-TYTYEWSFRKDVNMILQSTLGNDLRVDGASINIT
YP_068069   FHIQVPQKFFAIRNLLLLPG-TYTYEWSFRKDVNMILQSTLGNDLRVDGASINIE
AAB38725    FHIQVPQKFFAIRNLLLLPG-TYTYEWSFRKDVNMILQSSLGNDLRVDGATINIQ
AP_000059   FHIQVPQKFFAIRNLLLLPG-TYTYEWSFRKDVNMILQSSLGNDLRVDGASINIQ
ADD17111    FHIQVPQKFFAIRNLLLLPG-TYTYEWSFRKDVNMILQSSLGNDLRVDGASITIQ
AAB02183    FHIQVPQKFFALKSLLLLPGATYTYEWSFRKDVNMILQSTLGNDLRADGAKINIE
BAA76968    FHIQVPQKFFALKSLLLLPG-TYTYEWSFRKDVNMILQSTLGNDLRADGAKINIE
AAF82136    FHIQVPQKFFAIKNLLLLPG-TYNYEWSFRKDVNMIFQSSLGNDLRVDGAKITIE
ABG22140    FHIQVPQKFFAIRNLLLLPG-TYTYEWSFRKDVNMVLQSTLGNDLRVDGASITID
ABG22147    FHIQVPQKFFAIRNLLLLPG-TYTYEWSFRKDVNMVLQSTLGNDLRVDGASITIE
ABG22141    FHIQVPQKFFALKNLLLLPG-TYTYEWSFRKDVNMILQSTLGNDLRVDGASITID
ABG22142    FHIQVPQKFFALKNLLLLPG-TYTYEWSFRKDVNMILQSTLGNDLRVDGASINID
ABG22148    FHIQVPQKFFALKNLLLLPG-TYTYEWSFRKDVNMILQSTLGNDLRVDGASIKID
ACV96785    FHIQVPQKFFAIRNLLLLPG-TYTYEWSFRKDVNMILQSTLGNDLRVDGASIIID
AAB48187    FHIQVPQKFFAIKSLLLLPG-SYTYEWSFRKDVNMVLQSSLGNDLRADGARLEIH
ACJ14517    FHIQVPQKFFAIKNLLLLPG-SYTYEWSFRKDVNMVLQSTLGNDLRADGASLEIH
AAC41020    FHIQVPQKFFAIKNLLLLPG-TYNYEWYFRKDPNMIFQSSIGNDLRADGAYINYS
AAF13265    FHIQVPQKFFAIKNLLLLPG-TYNYEWYFRKDPNIVLQSSIGNDLRADGAIITYT
AAF20946    FHIQVPQKFFAIKNLLLLPG-TYNYEWYFRKDPNMVFQSTLGNDLRADGATITYT
AAL73247    FRIQVPQKFFAIKNLLLLPG-TYNYEWFFRKDPNMILQSTLGNDLRYDGASITYT
CAA70809    FHIQVPQKFFALRNLLLLSG-TYNYEWYFRKDPNMILQSTLGNDLRADGASVTYT
AAL92452    FHIQVPQKFFAIKNLLLLPG-TYNYEWYFRKDPNMVLQSTLGNDLREDGAQITYN
AAD51863    FHIQVPQKFFAIKNLLLLPG-TYSYEWWFRKDPNLVLQSTLGNDLRKDGASIQLA
NP_047393   FHIQVPQKFFAIKNLLLLPG-TYSYEWWFRKDPNLVLQSTLGNDLRKDGASIQFS
ACH89474    FHIQVPQKFFAIKNLLLLPG-TYTYEWWFRKDPNLVLQSTLGNDLRKDGAVIEYT
ACW84430    FHIQVPQKFFAIKSLLLIPG-TYTYEWWFRKDPNLVLQSTLGNDLRADGASVQFT
AAF86932    FHIQVPQKFFAIKKLLLLPG-TYTYEWWFRKDPNMVLQSSLGNDLRLDGATIQYT
CAD42235    FAIQVPNKFFAIKNLALLPG-NYNYEWKFRKDVNMVLQSTLGIDLRADEATIDYS
AAC54912    FHIQVPQKYFAIKNLLLLPG-TYTYEWVLRKDPNMILQSSLGNDLRADGAQIVYT
AP_000418   FHIQVPQKYFAIKNLLLLPG-TYTYEWVLRKDPNMILQSSLGNDLRADGAQIVYT
NP_050287   FHIQVPQKYFAIKNLLLLPG-TYTYEWVLRKDPNMILQSSLGNDLRADGASIVYS
AAV90966    FHIQVPQKYFAIKSLLLLPG-TYTYEWVLRKDPNMVLQSSLGNDLRLDGARIVYQ
AAR96457    FHIQVPQKFFAIKNLLLLPG-SYTYEWNFRKDVNMVLQSSLGNDLRVDGASIKFD
AAX19408    FHIQVPQKFFAIKNLLLLPG-SYTYEWNFRKDVNMILQSSLGNDLRVDGASIRFD
ABH01053    FHIQVPQKFFAIKNLLLLPG-SYTYEWNFRKDVNMILQSSLGNDLRVDGASIRFD
AP_000275   FHIQVPQKFFAVKNLLLLPG-SYTYEWNFRKDVNMVLQSSLGNDLRVDGASISFT
CAA09917    FHIQVPQKFFAVKNLLLLPG-SYTYEWNFRKDVNMVLQSSLGNDLRVDGASISFT
AAT84627    FHIQVPQKFFAIRNLLLLPG-SYTYEWSFRKDVNMILQSTLGNDLRVDGASVRID
AAB88060    FHIQVPQKFFAIRNLLLLPG-TYTYEWSFRKDVNMILQSTLGNGLRVDGASITYE
Ad5 hexon   FHIQVPQKFFAIKNLLLLPG-SYTYEWNFRKDVNMVLQSSLGNDLRVDGASIKFD
            FHIQVPQKFFAIKNLLLLPG TYTYEW FRKDVNMILQSTLGNDLRVDGASI Y
```

FIG. 7F

| ID | Sequence |
|---|---|
| AAA42509 | SVNLYASFFPMSHNTASTLEAMLRNDTNDQSFNDYLSAANMLYPIPPNATQLPIP |
| ABG22145 | SVNLYASFFPMSHNTASTLEAMLRNDTNDQSFNDYLSAANMLYPIPPNATQLPIS |
| YP_068069 | SVNLYASFFPMSHNTASTLEAMLRNDTNDQCFTDYLSAANMLYPIAANATNVPIS |
| AAB38725 | SINLYASFFPMAHNTASTLEAMLRNDVNDQSFADYLSSANMLYPIPANTTNLPIS |
| AP_000059 | SINLYASFFPMAHNTASTLEAMLRNDVNDQSFADYLSAANMLYPIPANTTNLPIS |
| ADD17111 | SINLYASFFPMAHNTASTLEAMLRNDVNDQTFADYLSAANMLYPIPANTTNLPIS |
| AAB02183 | SVNLYASFFPMAHNTASTLEAMLRNDTNNQTFIDFLSSANMLYPIPANVTNLPIS |
| BAA76968 | SVNLYASFFPMAHNTASTLEAMLRNDTNNQTFIDFLSSANMLYPIPANVTNLPIS |
| AAF82136 | SVNLYASFFPMAHNTASTLEAMLRNETNDQTFNDYLSAANMLYPIPPQTSNVPIT |
| ABG22140 | SVNLYASFFPMAHNTASTLEAMLRNDTNDQSFIEYLSSANMLYPIPANATNLPIS |
| ABG22147 | SVNLYASFFPMAHNTASTLEAMLRNDTNDQSFIDYLSSANMLYPIPANATNLPIS |
| ABG22141 | SVNLYASFFPMAHNTASTLEAMLRNDTNDQSFIDYLSSANMLYPIPAKATNIPIT |
| ABG22142 | SVNLYASFFPMAHNTASTLEAMLRNDTNDQSFIEYLSSANMLYPIPAKATNIPIT |
| ABG22148 | SVNLYASFFPMAHNTASTLEAMLRNDTNDQSFIEYLSSANMLYPIPAKATNIPIT |
| ACV96785 | SVNLYASFFPMAHNTASTLEAMLRNDTNDQSFIDYLSAANMLYPIPAGATNIPIS |
| AAB48187 | SVNLYASFFPMAHNTASTLEAMLRNETNDQTFLDYLSSATMMFPIPAGQTQVPVS |
| ACJ14517 | SVNLYASFFPMAHNTASTLEAMLRNETNDQTFLEYLSSATMMFPIPAGQTQIPVS |
| AAC41020 | NINLYVSFFPMNYDTVSELELMLRNATNDQNFADYLGAVNNLYQIPPNTSTVVVN |
| AAF13265 | SINLYVSFFPMNYETVSELELMLRNATNDQNFADFLGAVNNLYQIPANTNTIVVN |
| AAF20946 | NINLYVSFFPMNYETVSELELMLRNATNDQNFADYLGAVTNLYQIPANTNTVVVN |
| AAL73247 | AVNLYISFFPMNYDTVSELELMLRNSTNDQNFSDYLGAVNNLYQIPANTSTVVVN |
| CAA70809 | SINLYAFFPLAYDTVSELELMLRNATNDQNFSDYLGAVNNLYQIPANSTSVVVN |
| AAL92452 | QVNLYVSFFPMNYDTQSELELMLRNATNDQNFSDYLGAVNNLYQIPAGSNTVVVN |
| AAD51863 | VISLYASFFPMDHATCSELILMLRNDQNDQTFMDYMGAKNNLYLVPANQTNVQIE |
| NP_047393 | SISLYASFFPMDHATCSELILMLRNDQNDQTFMDYMGAKNNLYLVPANQTNVQIE |
| ACH89474 | NINLYASFFPMDHATCSELILMLRNDQNDQTFMDYLGAKNNLYVVPPDVSNLQIE |
| ACW84430 | SITLFASFFPMDHATASELILMLRNDTNDQTFMDYMGAKNNLYVVPPNTSHLQVE |
| AAF86932 | SINLFASFFPMDHATCNDLILMLRNETNDQSFMDYMGGKNNLYVVPPNTENLQIE |
| CAD42235 | RVKLYCPFFPFNHKDVAELDMLLRQQNNSQTFYDPLNSRSQFIEVPAGITNISVT |
| AAC54912 | EVNLMANFMPMDHNTSNQLELMLRNATNDQTFADYLGAKNALYNVPAGSTLLTIN |
| AP_000418 | EVNLMANFMPMDHNTSNQLELMLRNATNDQTFADYLGAKNALYNVPAGSTLLTIN |
| NP_050287 | EVNLMANFMPMDHNTSNQLELMMRNATNDQTFADYLGAKNALYQVPAGSTALTIN |
| AAV90966 | EVNLMASFMPMDHNTSNQLELMMRNAVNDQTFADYLGAKSALYSVPAQSTVLTIN |
| AAR96457 | SICLYATFFPMAHNTASTLEAMLRNDTNDQSFNDYLSAANMLYPIPANATNVPIS |
| AAX19408 | SINLYANFFPMAHNTASTLEAMLRNDTNDQSFNDYLCAANMLYPIPANATSVPIS |
| ABH01053 | SINLYANFFPMAHNTASTLEAMLRNDTNDQSFNDYLCAANMLYPIPANATSVPIS |
| AP_000275 | SINLYATFFPMAHNTASTLEAMLRNDTNDQSFNDYLSAANMLYPIPANATNVPIS |
| CAA09917 | SINLYATFFPMAHNTASTLEAMLRNDTNDQSFNDYLSAANMLYPIPANATNVPIS |
| AAT84627 | SVNLYANFFPMAHNTASTLEAMLRNDTNDQSFNDYLSAANMLYPIPANATNVPIS |
| AAB88060 | NITLYASFFPMAHNTASTLEAMLRNDTNDQSFIDYLSAANMLYTIPAGATQVPIS |
| Ad5 hexon | SICLYATFFPMAHNTASTLEAMLRNDTNDQSFNDYLSAANMLYPIPANATNVPIS |
|  | SVNLYASFFPMAHNTASTLEAMLRNDTNDQSF DYLSAANMLYPIPANATNVPIS |

FIG. 7G

| | |
|---|---|
| AAA42509 | S--RNWAAFRGWSLTRLKQRETPALGSPFDPYFTYSGTIPYLDGTFYLSHTFRKVAIQFDSSVTWPGNDRLLTPNEFEIKI |
| ABG22145 | IPSRNWAAFRGWSFTRLQRETPALGSAFDPYFTYSGTIPYLDGTFYLSHTFRRVAIQFDSSVTWPGNDRLLIPNEFEIKR |
| YP_068069 | IPSRNWAAFRGWSFTRLQKETPALGSPYDPYFTYSGSIPYLDSTFYLNHTFRRVAIQFDSSVSWPGNDRLLIPNEFEIKR |
| AAB38725 | IPARNWAGFRGWSFTRIKQRETPALGSPYDPYFTYSGSIPYLDATFYLSHTFRRVSIMFDSSVSWPGNDRLLIPNEFEIKR |
| AP_000059 | IPARNWAGFRGWSFTRIRQRETPALGSPYDPYFTYSGSIPYLDSTFYLSHTFRRVSIMFDSSVSWPGNDRLLIPNEFEIKR |
| ADD17111 | IPARNWAGFRGWSFTRIKQRETPALGSPFDPYFTYSGTMPYLDGTFYLSHTFRRVSIMFDSSVSWPGNDRLLTPNEFEIKR |
| AAB02183 | IPSRNWAAFRGWSFTRLKRNETPALGSPFDPYFTYSGSIPYLDGTFYLGHTFRRISIQFDSSVAWPGNDRLLTPNEFEVKR |
| BAA76968 | IPSRNWAAFRGWSFTRLKHNETPALGSPFDPYFTYSGSIPYLDGTFYLGHTFRRISIQFDSSVAWPGNDRLLTPNEFEVKR |
| AAF82136 | IPSRNWAAFRGWSFTRLKAKETPALGSPYDPYFTYSGSIPYLDGTFYLNHTFRKVAIQFDSSVSWPGNDRLLSPNEFEIKR |
| ABG22140 | IPSRNWAAFRGWSFTRIRQKETPALGSPFDPYFTYSGTIPYLDGTFYLNHTFRRVSIQFDSSVQWPGNDRLLIPNEFEIKR |
| ABG22147 | IPSRNWAAFRGWSFTRIKQKETPALGSPFDPYFTYSGTIPYLDGTFYLNHTFRRVSIQFDSSVQWPGNDRLLIPNEFEIKR |
| ABG22141 | IPSRNWAAFRGWSFTRIKQRETPALGSPFDPYFTYSGTIPYLDGTFYLNHTFRRVSIQFDSSVQWPGNDRLLIPNEFEIKR |
| ABG22142 | IPSRNWAAFRGWSFTRLKQRETPALGSPFDPYFTYSGTIPYLDGTFYLNHTFRRVSIQFDSSVQWPGNDRLLIPNEFEIKR |
| ABG22148 | IPSRNWAAFRGWSFTRLKQKETPALGSPFDPYFTYSGTIPYLDGTFYLNHTFRRVSIQFDSSVQWPGNDRLLIPNEFEIKR |
| ACV96785 | IPSRNWAAFRGWSFTRIKQKETPALGSAYDPYFTYSGTIPYLDGTFYLNHTFRRLAIQFDSSVSWPGNDRLLTPNEFEIKR |
| AAB48187 | IPARNWAAFRGWSFTRIKQQETPNIGSPYDPYFRYSGSIPFLDATFYLTHTFQRVSIMFDSSVSWPGNDRLLTPNEFEIKR |
| ACJ14517 | IPARNWAAFRGWSFTRLKQSETPNIGSPFDPYFTYSGSIPFLDATFYLTHTFQRVSIMFDSSVSWPGNDRLLTPNEFEIKR |
| AAC41020 | VPDRSWGAFRGWSFNRVKASETPMIGATKDPNFLYSGSIPYLDGTFYLTHTFQRVSIQWDSSVPWPGDDRLLIPNWFEIKR |
| AAF13265 | IPDRSWGAFRGWSFNRIKATETPMIGATKDPNFMYSGSIPLLDGTFYLTHTFQRVSIQWDSSVPWPGDDRLLIPNWFEIKR |
| AAF20946 | VPDRSWGAFRGWSFNRVKASETPMIGATKDPNFTYSGSIPLLDGTFYLTHTFQRVSIQWDSSVPWPGDDRLLVPNWFEIKR |
| AAL73247 | IPDRSWGAFRGWSFNRVKATETPMIGSTRDPNFTYSGTIPIPYLDGTFYLSHTFQRVSIQWDSSVPWPGDDRMLIPNWFEVKR |
| CAA70809 | VPDRSWGAFRGWSFTRIKARETPAIGATKDPNFTYISGSIPLLDGTFYLSHTFNRVSIQWDSSVPWPGNDRLLIPNWFEIKR |
| AAL92452 | IPDRSWGAFRGWSFTRLKVTETPRIGATQDPNFEYSGTIPYLDGTFYLSHTFQRCSIQWDSSVPWPGNDRLLVPNWFEIKD |
| AAD51863 | IPSRAWTAFRGWSFNRIKTAETPAVWSTYDLNFRYSGSIPYLDGTFYLSHTFNSMSILFDSAITWPGNDRMLVPNFFEIKR |
| NP_047393 | IPSRAWTAFRGWSFNRIKTAETPAVWSTYDLNFRYSGSIPYLDGTFYLSHTFNSMSILFDSAITWPGNDRMLVPNFFEIKR |
| ACH89474 | IPSRSWTAFRGWSFNRMKASETPAVWSTYDVNFRYSGSIPYLDSTFYLSHTFNSLAITFDSAVPWPGNDRLLLPNFFEIKR |
| ACW84430 | IPSRAWTGFRGWSFNRIRAQETPAINSTYDVNFRYSGSIPFLDSTFYLGHTFNSVSITFDSAIPWPGNDRLLLPNYFQIQR |
| AAF86932 | IPSRTWEAFRGWSFNRLKTAETPSVWSTYDVNFRYSGSIPYLDGSFYLSHTFKNIAINFDSAVPWPGNDRMLVPNYTEIKR |
| CAD42235 | VPAQSWSCFRGWKFNRLKASERCWNAVYETGLKYSGTYPHIDGTYYLGHTFRALEIKWDTSVPWPGNDRLFSPNYFEMKR |
| AAC54912 | IPARTWEGMRGWSFTRLKASETPQLGAQYDVGFRYSGSIPYSDGTFYLSHTFRSMSVLFDTSIMWPGNDRLLTPNLFEIKR |
| AP_000418 | IPARTWEGMRGWSFTRLKASETPQLGAQYDVGFRYSGSIPYSDGTFYLSHTFRSMSVLFDTSIMWPGNDRLLTPNLFEIKR |
| NP_050287 | IPARTWEGMRGWSFTRVKASETPQIGAQYDINFRYSGSIPYSDGTFYLTHTFRNMSVLFDTSIMWPGNDRLLAPNLFEIKR |
| AAV90966 | VPARTWEGMRGWSFTRLKAEETPQQGAQYDINFRYSGSIPYQDGTFYLNHTFRNMSILFDTSIMWPGNDRLLTPNMFEIKR |
| AAR96457 | IPSRNWAAFRGWAFTRLKTKETPSLGSSYDPYYTYSGSIPYLDGTFYLNHTFKKVAITFDSSVSWPGNDRLLTPNEFEIKR |
| AAX19408 | IPSRNWAAFRGWSFTRLKTKETPSLGSSFDPYFVYSGSIPYLDGTFYLNHTFKKVSIMFDSSVSWPGNDRLLTPNEFEIKR |
| ABH01053 | IPSRNWAAFRGWSFTRLKTKETPSLGSSFDPYFVYSGSIPYLDGTFYLNHTFKKVSIMFDSSVSWPGNDRLLTPNEFEIKR |
| AP_000275 | IPSRNWAAFRGWSFTRLKTKETPSLGSSFDPYFVYSGSIPYLDGTFYLNHTFKKVSIMFDSSVSWPGNDRLLTPNEFEIKR |
| CAA09917 | IPSRNWAAFRGWSFTRLKTKETPSLGSSFDPYFVYSGSIPYLDGTFYLNHTFKKVSIMFDSSVSWPGNDRLLTPNEFEIKR |
| AAT84627 | IPSRNWAAFRGWSFTRLKAKETPSLGSSFDPYFVYSGTIPYLDGTFYLNHTFKRLSIMFDSSVSWPGNDRLLTPNEFEIKR |
| AAB88060 | IPSRNWAAFRGWSFTRIKAKETPALGSPFEPYFNYSGTIPYLDGTFYLSHTFRRVSVQFDSSALGPETTVFTPNEFEIKR |
| Ad5 hexon | IPSRNWAAFRGWAFTRLKTKETPSLGSGYDPYYTYSGSIPYLDGTFYLNHTFKKVAITFDSSVSWPGNDRLLTPNEFEIKR |
| | IPSRNWAAFRGWSFTRLK KETPALGS YDPYFTYSGSIPYLDGTFYLSHTFRRVSI FDSSV WPGNDRLLTPNEFEIKR |

FIG. 7H

| | | |
|---|---|---|
| AAA84981 | 238 | IGRQLPKITPFSISGVEGIDVQDVNR---VQAAAVTF- |
| AF036092_4 | 237 | IGRQLPKITAYTITGVEGIDAQDVSK---VQAAAVMY- |
| NP_077399 | 237 | IGRQLPKITAYTITGVEGIDAQDVSK---VQAAAVMY- |
| AP_000090 | 247 | LGRQIPKMIPYTVSGVENISVKDLDP---VKAVGVKY- |
| YP_001552257 | 235 | LGRQLCKLIPFSISGTEGLREEDVSP---VQAVSVRH- |
| AAC54914 | 316 | SGRQFCKMIPYKLNGTDDITRDMVESRP-DMKAHKKN- |
| AP_000420 | 424 | SGRQFCKMIPYKLNGTDDITRDMVESRP-DMKAHKKN- |
| AF083975_13 | 308 | SGRQVCRMIPYKLSGTDDIASDTARSRP-DMKAHKKY- |
| AP_000386 | 427 | SGRQVCRMIPYKLSGTDDIASDTARSRP-DMKAHKKY- |
| AAC64534 | 216 | LGRQICRMIAFEIPGANDIDPESCHDD--MLLATAKY- |
| AP_000488 | 250 | LGRQICRMIAFEIPGANDIDPESCHDD--MLLATAKY- |
| AF224336_14 | 251 | VGRQISKLIPFEIPGSNDLTQDQMDECG-MMKATGQH- |
| ACJ14519 | 335 | LGRQTCRLIPYQLSLAEGLDGGNMDA---VAKASVEN- |
| AP_000353 | 338 | LGRQTCRVTPYALSLAEGLDATALDP---VARASVEN- |
| AAS10371 | 390 | MGRQTCKMTPFGMANAEDLDVEGITD--ATVLASVKH- |
| AAS10443 | 389 | MGRQTCKMTPFGMANAEDLDVEGITD--ATVLASVKH- |
| AAS10407 | 389 | MGRQTCKMTPFGMANAEDLDVEGITD--ATVLASVKH- |
| AAX19410 | 340 | IGRQMCKLTPFALSNAEDLDASEVTD--PTALASIHN- |
| ABH01055 | 340 | IGRQMCKLTPFALSNAEDLDASEVTD--PTALASIHN- |
| ACB40926 | 371 | AGRQVCKITPFALPGAEDMKHDEVTD--PVALASLNH- |
| ADD17113 | 354 | LGRQTCRMTPYALSSTADIDRSLVQD--AKMLATLDH- |
| AP_000061 | 336 | LGRQTCKITPFSLASANHIDKSEVDD--QRMLATLNN- |
| AP_000624 | 336 | LGRQTCKITPFSLASASHIDKSEVDD--QRMLATLNN- |
| AAC35886 | 314 | LGRQMCKVTPFSMSGGRLIVEKHLIDRIPKLLAYLCNN |
| AF289262_25 | 323 | LGKQTCKVTPFAMSTAGNIDRNLIDD--PKVLATLDH- |
| AP_000014 | 324 | LGKQTCKVTPFALNAVSNIDRSLVED--AKVLATLNN- |
| BAA76970 | 339 | LGRQTCKITPFALSGSAALNPQLVED--PKILASVTH- |
| AP_000033 | 314 | LGRQVCKITPFNINAGSAVDKSLVED--PKLLASVEH- |
| YP_068072 | 349 | LGRQVCKVTPFTISATESIDRELVQD--PKILATVHN- |
| Ad5 DBP | 408 | LGRQLPKLTPFALSNAEDLDADLISD--KSVLASVHH- |
| Consensus | 517 | LGRQLCKMTPF LSGAEDID    V D    MLASV H |

FIG. 7I

```
AAA84981      PAVFVFQCCNYQYNLRRNN----------GKFCEMKISLPD
AF036092_4    PAVFVFQCCNFQFTSKRNT----------TKFCEMKISVPD
NP_077399     PAVFVFQCCNFQFTSKRNT----------TKFCEMKISVPD
AP_000090     PAVFVFQCCNFQGQKRAGN----------AKSCEFKISLPD
YP_001552257  PAVFVFQCCNATGGSKGK-----------TSCDFKISHAD
AAC54914      PHTMVFTCCNPQAASGGAG------RGLKKTEKTCAWRLSAMD
AP_000420     PHTMVFTCCNPQAASGGAG------RGLKKTEKTCAWRLSAMD
AF083975_13   PHTMVYTCCNPQSPSGTDGPTSRSGRKTSDKTCAWRLSAMD
AP_000386     PHTMVYTCCNPQSPSGTDGPTSRSGRKTSDKTCAWRLSAMD
AAC64534      KHTFVFQCCNPIRLKRNAK------DKDNQTHKHCDFKLSMID
AP_000488     KHTFVFQCCNPIRLKRNAK------DKDNQTHKHCDFKLSMID
AF224336_14   QATIVFLCCNPVNFR----------AKVTIAKNCDFKLSMID
ACJ14519      PVVLVAQCCNVTFSKAGKAGG------AAAGKTCEWKISSVD
AP_000353     PVVLVYQCCNVTFGKAGKG--------TVG-KSCEWKISSVD
AAS10371      PALMVFQCCNPVYRNSRAQ----------NAGPNCDFKISAPD
AAS10443      PALMVFQCCNPVYRNSRAQ----------NAGPNCDFKISAPD
AAS10407      PALMVFQCCNPVYRNSRAQ----------NAGPNCDFKISAPD
AAX19410      PGVLVFQCANPVFRNSRGS----------SG-PNCDFKISAPD
ABH01055      PSVLVFQCANPVFRNSRGG----------SG-PNCDFKISAPD
ACB40926      PSLLVFQCANPAYRNTRAT----------NQ-VNCDFKISAID
ADD17113      PAMLVFQCCNPVYRNSKAA----------PQ-KNCDFKISTVD
AP_000061     PAMLVFQCCNPVYRNSKAA----------PQ-KNCDFKISSVD
AP_000624     PAMLVFQCCNPVYRNSKAA----------PQ-KNCDFKISSVD
AAC35886      PSILVFQCCNPVYRHSKAN----------PQ-KNCDFKISAPD
AF289262_25   PAVLVFQCCNPVFRNTKAN----------PQ-KNCDFKISSTD
AP_000014     PVVLVFQCCNPVFRNTKAN----------PQ-KNCDFKISSTD
BAA76970      PAVLVFQCYNPVYRGSRGN----------PQ-KNCDFKISAPD
AP_000033     PSVLVFQCCNPVYRQTRAN----------AQ-RNCDFKISAPD
YP_068072     PAVLVFQCCNPVYRNSRAN----------PQ-KNCDWKISAPD
Ad5 DBP       PALIVFQCCNPVYRNSRAQ----------GGGPNCDFKISAPD
Consensus     PAVLVFQCCNPVYR SRA           KNCDFKISA D
```

FIG. 7J

| | | |
|---|---|---|
| AAA42432 | 4 | PSPYVWTFQPQRGTAAGASQDYSTRINWLSAGPELRGK |
| ACJ14523 | 4 | PSPYMWTFQPQRGTAAGASQDYSTRLNWLSAGPSLRGK |
| AAA73918 | 5 | VTPYVWKYQPETGYTAGAHQNYNTVINWLHANPQMFAR |
| NP_659528 | 5 | VTPYVWKYQPETGYTAGAHQNYNTVINWLHANPQMFAR |
| AF036092_18 | 4 | VTPYIWKYQPETGHTAGAHQDYGSVINWLQSNPQMFNR |
| CAA68124 | 4 | VTPYLWRYQPETGTAAGARQDYGAVINWFNSGPDLYRR |
| YP_001552261 | 5 | VTPYIWQYQPETGTAAGARQNYGAVINWLSSDNNMYHR |
| AAB88280 | 8 | PTPYVWKYNPVTGKCAGANRTT-AHYRLVLPGGNSFAY |
| AAC55292 | 8 | PTEYVWKYNPLSGIPAGAQQNYGATINWVVPGGNSFAY |
| AF083975_16 | 8 | PTEYVWKYNPLSGIPAGAQQNYGATINWVVPGGNSFAY |
| CAA59205 | 8 | PTEYVWKYNPVSGIPAGAQQNYGATIDWVLPGGTGFAI |
| AAC64536 | 5 | PLEYIWQYNPVTGRVGGANQNYGQRINVLHTNRYLYNR |
| AAX51186 | 5 | PLEYIWQYNPVTGRVGGANQNYGQRINVLHTNRYLYNR |
| NP_047398 | 5 | PLEYIWQYNPVTGRVGGANQNYGQRINVLHTNRYLYNR |
| AF224336_18 | 5 | PSEYIWQYNPVTGRVVGASQNFGARINTLHASPQLWAR |
| AAA51001 | 8 | PTPYVWSYQPMGVPAGASQDYSTKINCLSAGPRMAQT |
| AAL86536 | 6 | PTPYVWNYQPQAGTAAGASQDYSTRLHWLSAGKSMISK |
| AAD09733 | 6 | PTPYVWTFQPQMGAAAGASQDYSTRMNWFSAGPDMIHD |
| YP_068076 | 6 | PTPYVWTFQPQMGVAAGASQDYGTKMNWLSAGPSMIHR |
| AAC40820 | 6 | PTPYVWTFQPQLG-GCGASQDYSTRMNWLSAGPSMINQ |
| AP_000018 | 6 | PTPHMWTFQPQLGQAAGASQDYSTRMNWLSAGPSMISQ |
| AAB22306 | 6 | PTPYMWSYQPQTGHAAGASQDYSTQMNWFSAGPSMISQ |
| AP_000065 | 6 | PTPYIWSYQPQTGHAAGASQDYSTQMNWFSAGPSMISH |
| ADD17117 | 6 | PTPYMWSFQPQSGHAAGAAQDYSTQMNWFSAGPSMINQ |
| AAB42037 | 6 | PTPYMWSYQPQSGRAAGASVDYSTRMNWLSAGPSMIGQ |
| BAA76972 | 6 | PTPYMWSYQPQSGRAAGASVDYSTRMNWLSAGPSMIGQ |
| AAS10374 | 6 | PTPYMWSYQPQMGLAAGAAQDYSTRMNWLSAGPAMISR |
| AAS10410 | 6 | PTPYMWSYQPQMGLAAGAAQDYSTRMNWLSAGPAMISR |
| AAS10446 | 6 | PTPYMWSYQPQMGLAAGAAQDYSTRMNWLSAGPAMISR |
| AAX19414 | 6 | PTPYMWSYQPQMGLAAGAAQDYSSKMNWLSAGPHMISR |
| ABH01058 | 6 | PTPYMWSYQPQMGLAAGAAQDYSSKMNWLSAGPHMISR |
| Ad5 pVIII | 6 | PTPYMWSYQPQMGLAAGAAQDYSTRINYMSAGPHMISR |
| Consensus | 8 | PTPYMWSYQPQTG AAGASQDYSTRINWLSAGP MISR |

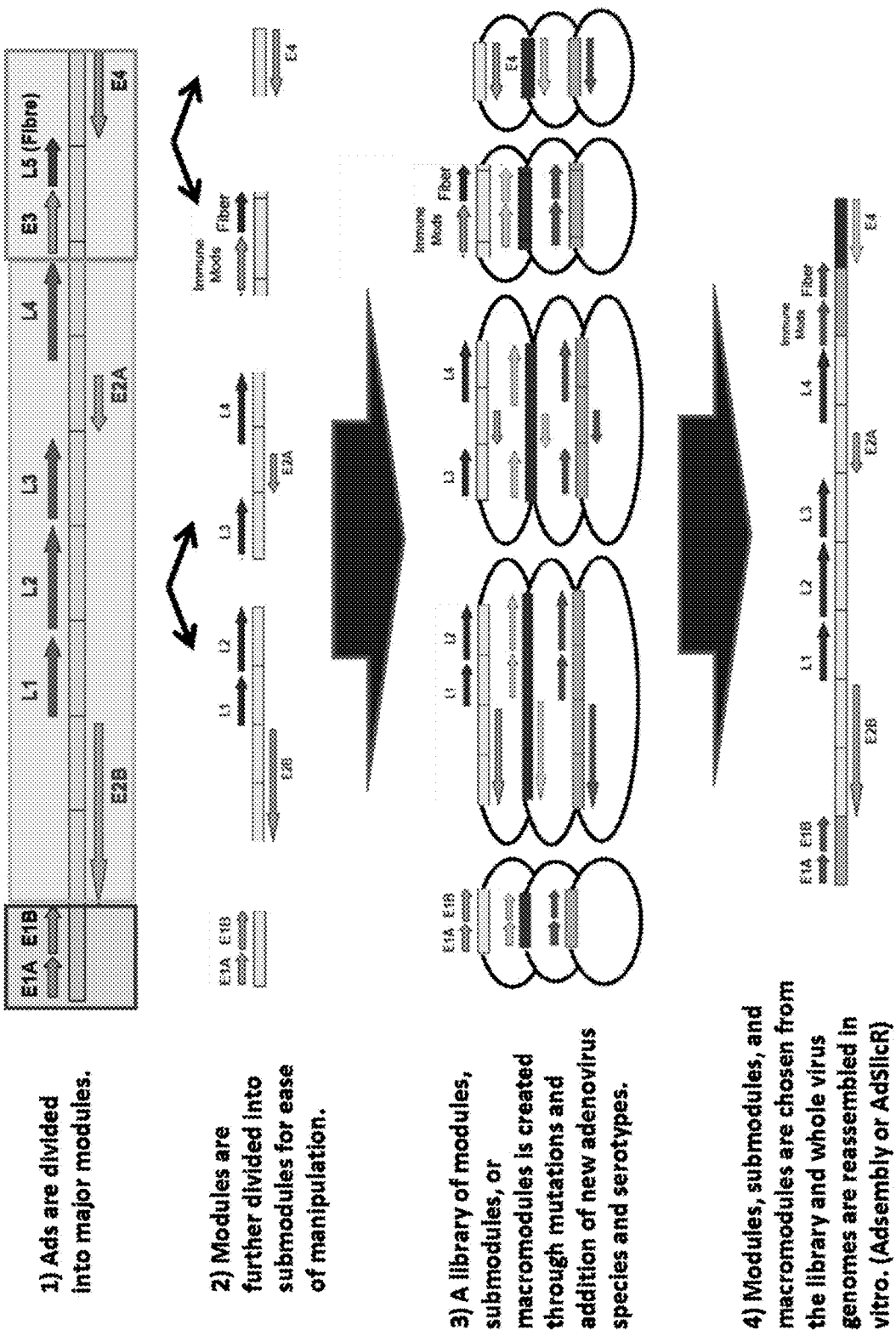

FIG. 13

1) Obtain fragments by PCR

Challenges:
- Large fragments (as big as 14kb)
- Limited flexibility for primer design
- Lack of "easy" plasmid template for most – needs to work from virus
- Want it to be high fidelity Result:
- In the example of Ad5, all five fragments can consistently be amplified from both plasmid template (when available) or from viral DNA prepared from purified virus. The enzyme we used for this was Finnzymes Phusion (NEB).
- Only the largest (14 kb) E2 fragment required modification from the standard buffer (3% DMSO).
- Reproducibility refers to the consistency of the sequence obtained from different PCRs of the same fragment. For example, every fragment was isolated by PCR and sequenced several times with the sequence being the same, meaning that the differences seen versus WT Ad5 were likely changes already present in the template that was used. Thus, the fidelity was near 100%.

Fidelity:

| Fragment | Size (bp) | Total differences vs WT Ad5 (AC_000008) | Amino acid changes | Reproducibility of the changes vs WT Ad5 |
|---|---|---|---|---|
| E1 | 4075 | 0 | 0 | 100% |
| E2-L2 | 13884 | 7 | 5 | 100% |
| L3-L4 | 9214 | 15 | 4 | 100% |
| E3-L5 | 5769 | 10 | 4 | 100% |
| E4 | 3150 | 3 | 0 | 100% |

FIG. 15

| Fragment | Size (bp) | pDONR | Estimated colonies/transformation | Correct clones |
|---|---|---|---|---|
| E1 | 4075 | P1-P5R | 400 | 0/54 |
| E2-L2 | 13884 | P5-P6 | 33 | 0/20 |
| L3-L4 | 9214 | P6R-P4 | 80 | 0/8 |
| E3-L5 | 5769 | P4R-P3R | >2000 | 4/4 |
| E4 | 3150 | P3-P2 | >2000 | 4/4 | from Li and Elledge. Nature Methods. 2007. v4:no3. p251-256

FIG. 22

Efficiencies of various combinations of counterselection cassettes in the Adsembly system

| rpsL + ccdB | ccdB + ccdB | PheS + ccdB (blind screens) | PheS + ccdB (E1 colony PCR positive clones) |
|---|---|---|---|
| 0/28 (0%) | 1/6 (17%) | 26/103 (25%) | 4/8 (50%) |

FIG. 26

|  | Colony PCR screen | Restriction digest screen |
|---|---|---|
| E2 + L3 submodules SLIC | 13/24 (54%) | 4/4 (100%) |
| E3 + E4 submodules SLIC | 27/35 (77%) | 5/6 (83%) |
| E1 module SLIC | - | 16/16 (100%) |

FIG. 29A

E1 entry vectors:
Ad5, wild-type
Ad34, wild-type
Ad5, E1B-55K H260A mutation
Ad5, ΔE1A/E1B (contains a short multiple cloning site of PacI-PmeI-AscI)
Ad5, ΔE1A/E1B + CMVpromoter-multiple cloning site (standard MCS)
Ad5, ΔE1A/E1B + CMVpromoter-eGFP
Ad5, ΔE1A/E1B + CMVpromoter-MCS-IRES-eGFP

E2 entry vectors:
Ad5, wild-type

L3 entry vectors:
Ad5, wild-type
Ad5, hexon E451Q mutation (eliminates liver targeting)

E3-Fiber entry vectors:
Ad5, wild-type
Ad5, fiber flanked by PmeI sites
Ad5, contains the Ad34 fiber in place of the Ad5 fiber
Ad5, fiber contains the mTOR FRB domain in its HI-loop
Ad5, bombesin peptide fused to the C-terminus of the fiber
Ad5, WT fiber linked to FKBP-Bombesin (FKBP-Bombesin fusion linked to fiber translation with Furin-2A cleavage site).
Ad5, FRB fiber linked to FKBP-Bombesin (FKBP-Bombesin fusion linked to fiber translation with Furin-2A cleavage site).
Ad5, ΔRIDα/β/14.7K + FKBP-Bombesin, WT Fiber (FKBP-Bombesin expressed from E3 region)
Ad5, ΔRIDα/β/14.7K + FKBP-Bombesin, FRB Fiber (FKBP-Bombesin expressed from E3 region)

E4 entry vectors:
Ad5, wild-type
Ad34, wild-type
Ad5, E4orf3 I104R mutation
Ad5, ΔE4orf3 (coding region deleted)
Ad5, E4orf3 mini-SOG
Ad5, E4orf3 D105A + L106A mutations

FIG. 29B

Macromodule core vectors for Adsembly (flanked by gateway counterselection cassettes):
Ad5, E2+L3, wild-type
Ad5, E2+L3 joined by an attB6 site

Macromodule core vectors for AdSLIC:
Ad5, E2+L3, wild-type
Ad5, E1+E2+L3, wild type
Ad5, E1+E2+L3+E3-fiber, wild-type
Ad5, E2+L3+E3-fiber+E4, wild type
Ad5, E2+L3+E3-fiber+E4, E4orf3 I104R mutation
MAV-1, E2+L3, wild-type
MAV-1, E2+L3+E3-fiber+E4, wild-type
Ad9, E2+L2, wild-type
Ad12, E2+L2, wild-type

FIG. 29C

Genome assembled using Adsembly:
- Ad5, wild-type (contains all 4 attB insertions)
- Ad5, wild-type (contains 3 attB insertions)
- Ad5, ΔE1A/E1B + CMVpromoter-MCS-IRES-eGFP
- Ad5, ΔE1A/E1B + CMVpromoter-MCS-IRES-eGFP, with Ad34 Fiber
- Ad5, ΔE1A/E1B + CMVpromoter-MCS-IRES-eGFP, FRB fiber
- Ad5, ΔE1A/E1B + CMVpromoter-eGFP, bombesin fused to wild-type fiber C-terminus
- Ad5, ΔE1A/E1B + CMVpromoter-eGFP, wild-type fiber linked to FKBP-bombesin by Furin-2A cleavage site
- Ad5, ΔE1A/E1B + CMVpromoter-eGFP, FRB fiber linked to FKBP-bombesin by Furin-2A cleavage site
- Ad5, ΔE1A/E1B + CMVpromoter-eGFP, ΔRIDα/β/14.7K + FKBP-Bombesin, WT fiber
- Ad5, ΔE1A/E1B + CMVpromoter-eGFP, ΔRIDα/β/14.7K + FKBP-Bombesin, FRB fiber
- Ad5, E1B-55K H260A + E4orf3 I104R (virus contains all 4 attB sites)

Genomes assembled using AdSLIC:
- Ad5, wild-type
- Ad5, attB4 insertion only
- Ad5, attB6 insertion only
- Ad5, attB5 insertion only
- Ad5, attB3 insertion only
- Ad5, attB4 + attB3 insertions
- Ad5, attB4 + attB6 + attB3 insertions
- Ad5, E1B-55K H260A + E4orf3 I104R
- Ad5, ΔE4orf3
- Ad5, E4orf3 mini-SOG
- Ad9, wild-type
- Ad12, wild-type
- Mouse Adenovirus 1, wild-type

FIG. 34
A PCR-free seamless AdSLICr system for Mouse Adenovirus type 1
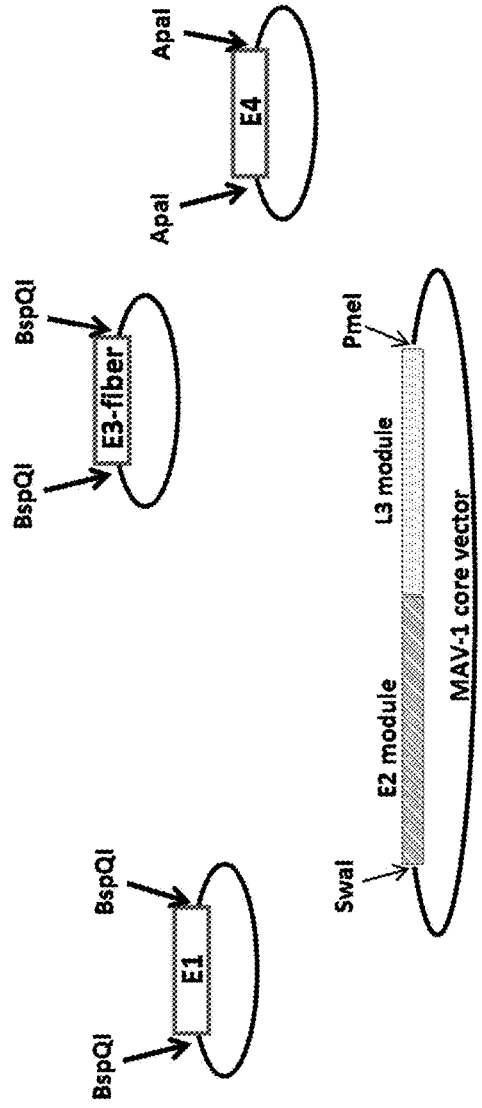
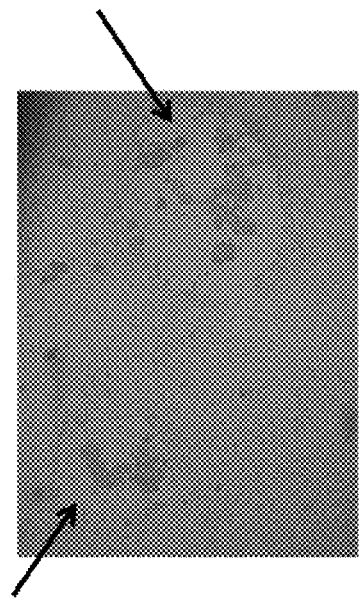
MAV-1 plaques from a wild-type MAV-1 assembled using AdSLICr FIG. 38 Altering the attB site placement at the [E1]-[E2] and [E3]-[E4] junctions restores virus growth to wild-type levels FIG. 39
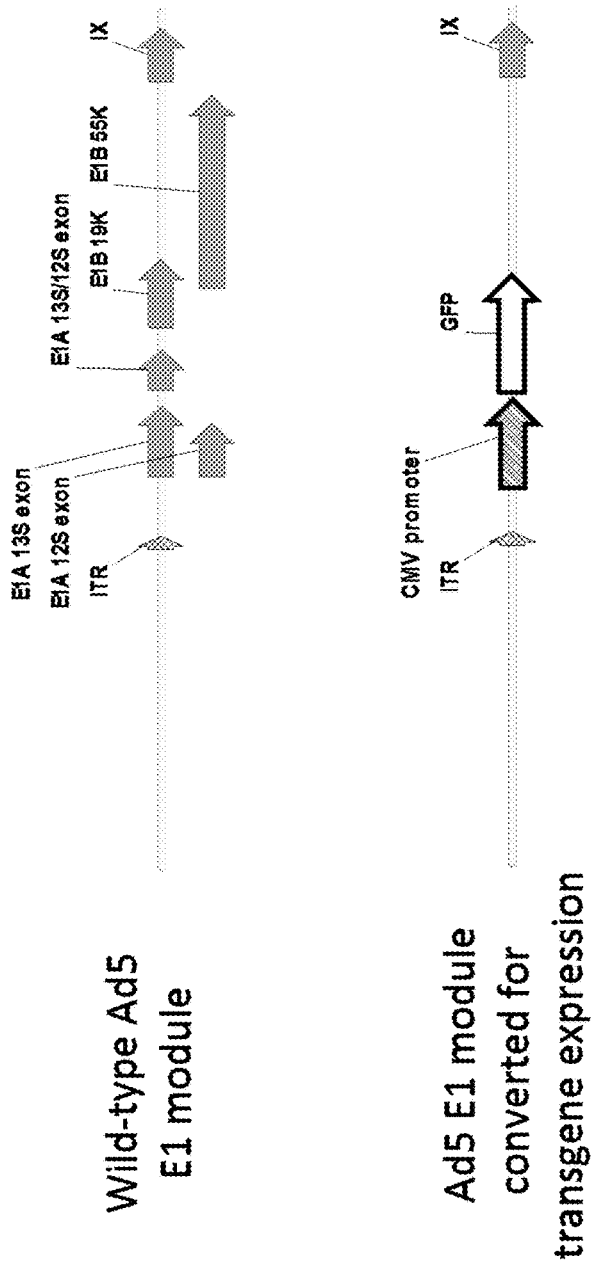
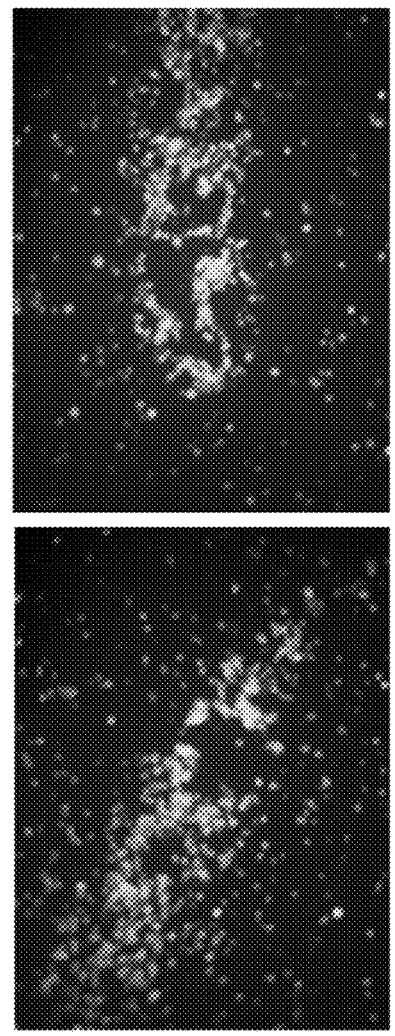

FIG. 40
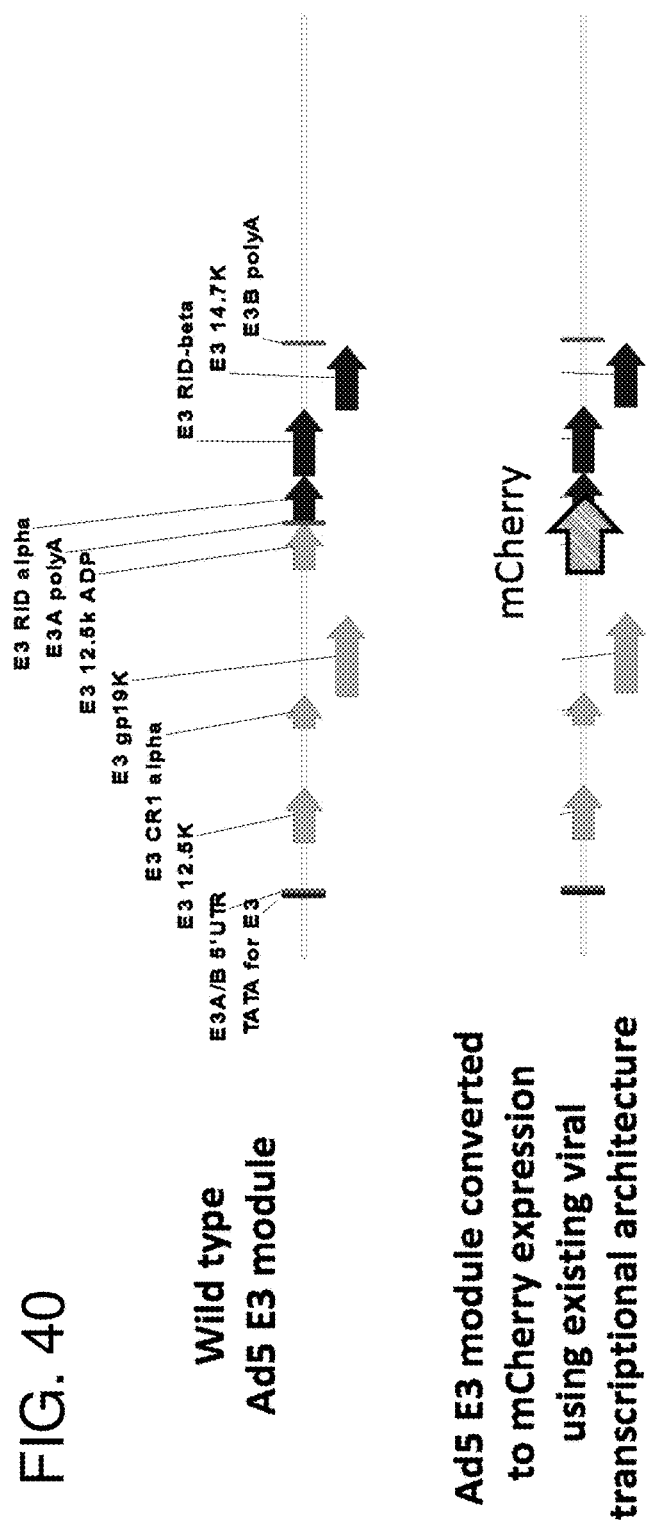
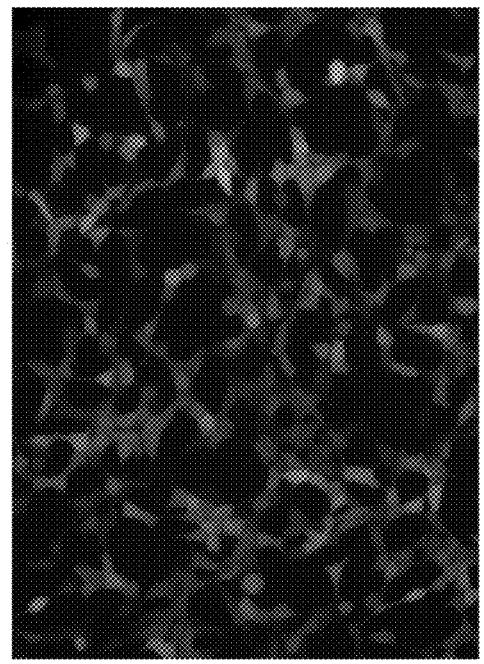
Wild type Ad5 E3 module
Ad5 E3 module converted to mCherry expression using existing viral transcriptional architecture
Transduced 293 cells expressing mCherry

Expression of multiple transgenes from one promoter using the native viral transcriptional architecture

FIG. 44

Improved transduction of human embryonic stem cells using chimeric viruses created by Adsembly

FIG. 45

Exchange of core modules between Adenovirus serotypes produces viable virus

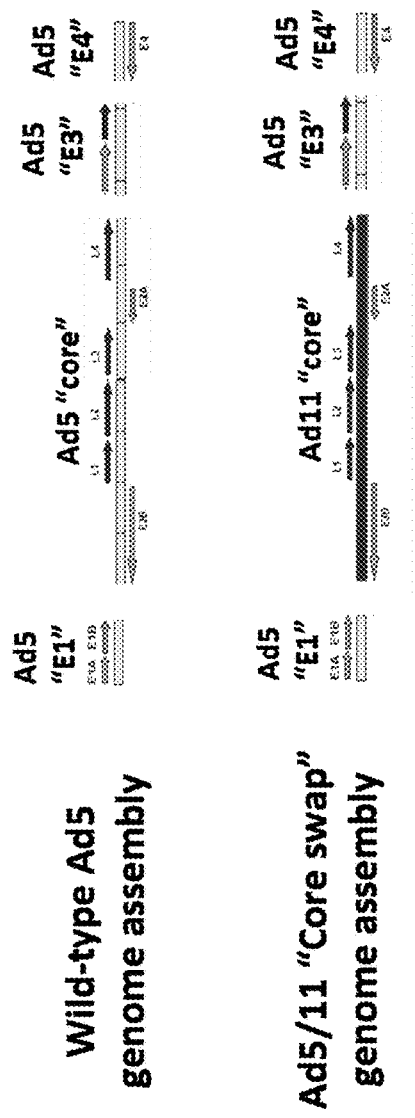
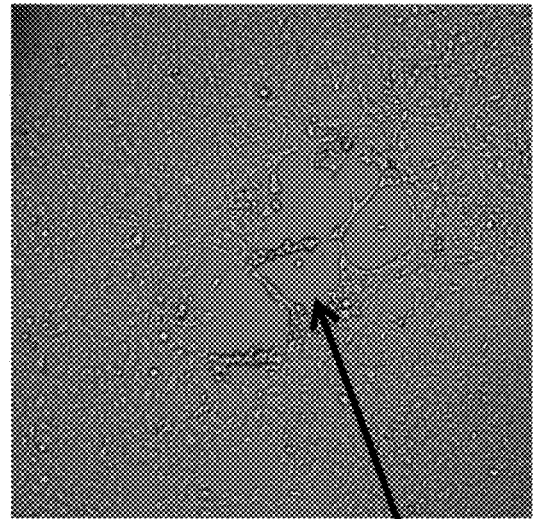

Plaque from the Ad5/11 "core swap" virus made by AdSLICr

Other changes made:
- In the E1 module, the Ad5 pIX was replaced with the Ad11 pIX.
- In the E3 module, the Ad5 U exon and fiber were replaced with the Ad11 U exon and fiber.

Final virus:
Ad5 1-3630, TTA insertion, Ad11 3483-3899, Ad5 4029-4078, Ad11 3951-27184, GG insertion, Ad5 27858-30858, TT insertion, Ad11 30626-31786, AA insertion, Ad5 32785-35938

Use of AdSLIC to mutate adenovirus genes for functional studies

ADENOVIRAL ASSEMBLY METHOD

CROSS REFERENCE TO RELATED APPLICATIONS

This application is a continuation of U.S. application Ser. No. 13/769,025, filed Feb. 15, 2013, which is a continuation of PCT Application No. PCT/US2011/048006, filed Aug. 16, 2011, which applications claims the benefit of U.S. Provisional Application No. 61/374,198 filed Aug. 16, 2010. The above-listed applications are hereby incorporated by reference in their entirety and for all purposes.

ACKNOWLEDGMENT OF GOVERNMENT SUPPORT

This invention was made with government support under grant number CA137094 awarded by the National Institutes of Health. The government has certain rights in the invention.

INCORPORATION OF ELECTRONIC SEQUENCE LISTING

The nucleic and amino acid sequences listed in the accompanying sequence listing are shown using standard letter abbreviations for nucleotide bases, and three letter code for amino acids, as defined in 37 C.F.R. 1.822. The Sequence Listing is submitted as an ASCII text file, created on Dec. 4, 2017, 1.12 MB, which is incorporated by reference herein.

BACKGROUND

There are 52 human Adenoviruses which infect different human tissues and hundreds of adenoviruses that infect other species ranging from fish to primates. These viruses are highly efficient nanomachines that deliver their genomic payload to the nucleus within an hour of infection. As DNA viruses, they do not integrate into host DNA, they can be produced to high titers using established GMP protocols, and they have demonstrated safety in research and human gene therapy applications for the expression of ectopic genes. However, to date, their potential applications have been hindered by the almost exclusive use of one variety, Ad5 or an Ad2/5 chimera and the inability to engineer and combine multiple genetic modifications rapidly and systematically. Thus, there is a great need to extend the repertoire adenoviral vectors beyond that of Ad2/5 and to develop a technological platform that facilitates the rapid, de novo assembly of novel adenoviral genomes from component parts, allowing the systematic incorporation of multiple modifications and heterologous elements. Such a system would take advantage of the natural viral architecture, which is highly efficient in both delivering and expressing 36 genes (not including splice variants). The system could provide powerful diagnostic agents and therapeutic agents that incorporate multiplex and quantitative measurements of the pathway activities deregulated in different tumor samples.

The potential of adenoviral vectors in several applications is hindered by the ability to manipulate the 36 kb viral genome rapidly and systematically. Furthermore, the adenoviral vectors used in basic research, animal models, gene therapy and oncolytic therapy are limited to Adenovirus (Ad) serotypes 2 and 5. Ad2 and Ad5 were among the first to be discovered and, as such, there is a legacy of vectors/tools with which to manipulate their genomes, particularly in the E1 region. Ad2/5 Fiber proteins infect epithelial cells by binding to the receptor, CAR. Unfortunately, CAR is not expressed on all cell types and is downregulated on many metastases. Furthermore, approximately 80% of the human population has pre-existing neutralizing antibodies against Ad2/5, which together with off-target liver uptake and inflammation, limits systemic applications. Thus, the use of Ad2/5 vectors for gene delivery and cancer therapy is not necessarily an optimal choice, quite the contrary, but largely an accident of history.

Our ultimate goal is to engineer potent viral cancer therapies that not only undergo tumor selective lytic replication but which can be administered systemically in repeated rounds of treatment, avoid liver toxicity, efficiently target and cross the torturous tumor vasculature, infect cells via disparate receptors, generate a tumor bystander effect by localized expression of pro-drug activating enzymes/toxins within the tumor and which reawaken a beneficial host anti-tumor immune response. These are major challenges which are further compounded by the inability of human adenovirus to replicate in mice. This precludes the evaluation of human oncolytic viruses in immune competent genetically engineered mouse models of cancer (GEMMs) which have many advantages over xenograft models.

There are 52 human adenoviruses, indicating highly specialized adaptation for infecting and replicating in different host tissue environments. Many of these viruses infect different tissues and have Fiber proteins that bind cellular receptors other than CAR as well as a distinct cohort of 'E3' immune-modulation genes. Their unique properties have not been extensively studied or exploited due to the lack of tools necessary to modify their genomes. Similarly, there are also adenoviruses that infect other species, including mouse adenovirus (MAV-1).

Provided herein are solutions to these and other problems in the art.

SUMMARY

In one aspect, a method is provided for making a recombinant adenovirus (also referred to herein as "Adsembly"). The method includes assembling a nucleic acid from two or more adenoviral gene modules selected from an E1 module, an E2-L2 module, an L3-L4 module, an E3 module, an E4 module, or an adenoviral macromodule (or mutant thereof as described below).

In another aspect, a library including a plurality of adenoviral gene modules are provided.

In another aspect, kits are provided for practicing the methods provided herein.

BRIEF DESCRIPTION OF THE DRAWINGS

FIG. 1. A comparison chart of the existing adenovirus vector methods and Adsembly. There are several limitations with the current systems that Adsembly overcomes.

FIG. 4. Receptors and tropisms for the 52 known human adenoviruses. Receptors and tropisms vary between serotypes and subgroups, and can thus be exploited for retargeting certain viruses.

FIGS. 7A-7C. Alignment of amino acids 966-1103 of the human Ad5 polymerase protein as set forth in SEQ ID NO: 32 (on the bottom, just above the consensus) with the corresponding regions in several polymerase proteins from non-human adenoviruses. Any of the non-human Ad sequences are at least 45% identical within this region when individually compared to the Ad5 polymerase sequence. Labels on the left indicate GenBank accession number and correspond to SEQ ID NOs: 1-32 in order top to bottom, respectively. Consensus sequence shown in FIGS. 7A-7C are set forth as SEQ ID NOs: 148-150, respectively.

FIGS. 7D-7G. Alignment of amino acids 501-747 of the human Ad5 hexon protein as set forth in SEQ ID NO: 73 (on the bottom, just above the consensus) with the corresponding regions in several hexon proteins from non-human adenoviruses. Any of the non-human Ad sequences are at least 45% identical within this region when individually compared to the Ad5 hexon sequence. Residues highlighted in yellow are 100% conserved across species. Labels on the left indicate GenBank accession numbers and correspond to SEQ ID NOs: 33-73 in order top to bottom, respectively. Consensus sequence shown in FIGS. 7D-7G are set forth as SEQ ID NOs: 151-154, respectively.

FIGS. 7H-7I. Alignment of amino acids 408-475 of the human Ad5 DNA-binding protein as set forth in SEQ ID NO: 103 (DBP, on the bottom, just above the consensus) with the corresponding regions in several DBPs from non-human adenoviruses. Any of the non-human Ad sequences are at least 35% identical within this region when individually compared to the Ad5 DBP sequence. Residues highlighted in yellow are 100% conserved across species. Labels on the left indicate GenBank accession numbers and correspond to SEQ ID NOs: 74-103 in order top to bottom, respectively. Consensus sequences shown in FIGS. 7H and 7I are set forth as SEQ ID NOs: 155 and 156.

FIG. 7J. Alignment of amino acids 6-43 of the human Ad5 pVIII protein as set forth in SEQ ID NO: 135 (on the bottom, just above the consensus) with the corresponding regions in several pVIII proteins from non-human adenoviruses. Any of the non-human Ad sequences are at least 35% identical within this region when individually compared to the Ad5 pVIII sequence. Labels on the left indicate GenBank accession numbers and correspond to SEQ ID NOs: 104-135 in order top to bottom, respectively. Consensus sequence shown in FIG. 7J is set forth as SEQ ID NO: 157.

FIG. 8. An overview of the initial concept for adenovirus genomic manipulation.

(FIG. 12A) attB4 insertion between E1 and E2 modules. Ad5, Ad11, Ad7, Ad4, Ad12, Ad17, Ad41 and consensus E1-E2 junction sequences are set forth as SEQ ID NOs: 168-174 and 164, respectively. (FIG. 12B) attB6 insertion site between E2 and L3 modules. Ad11, Ad12, Ad17, Ad4, Ad41, Ad5, Ad7 and consensus E2-L3 junction sequences are set forth as SEQ ID NOs: 175-181 and 165, respectively. (FIG. 12C) attB5 insertion between L3 and E3 modules. Ad11, Ad12, ad17, Ad4, Ad41, Ad5, Ad7 and consencensus L3-E3 junction sequences are set forth as SEQ IN NOs: 182-188 and 166, respectively (FIG. 12D) attB3 insertion site between E3 and E4 modules. For this particular insertion, it was decided to buffer the recombination site by duplicating the Ad5 sequence between the fiber polyA/stop and the E4 polyA. Thus, along with the attB insertion is a duplication of the 27bp located between those two elements. Ad11, Ad12, Ad17, Ad4, Ad41, Ad5, Ad7 and consensus E3-E4 junction sequences are set forth as SEQ ID NOs: 189-195 and 167, respectively.

FIG. 13. Challenges and results of trying to obtain the five Ad5 modules by PCR. The table on the bottom lists the results of sequencing each fragment obtained by PCR and the differences with published Ad5 sequence. Since the reproducibility of all the errors was 100%, that suggests the template we used differs from the published Ad5 sequence, and the PCR fidelity is high.

FIG. 15. Efficiencies of the Ad5 adenoviral gene modules in gateway BP reactions. The E1, E2, and L3 modules were not efficient in the standard reactions, while the E3 and E4 modules were.

FIG. 22. Efficiencies of several counterselection markers attempted with the Adsembly method. PheS+ccdB is used and is efficient either by blind screen of colonies, or by first using colony PCR to identify insertions followed by standard restriction digest screening.

(FIG. 24A) An Adsembly reaction for Ad5 was performed using 20 fmol of the core dual DEST vector and 10 fmol each of E1 module, E3 module, and E4 module entry vectors. The reaction was carried out at room temperature overnight, and transformed into NEB 10—β cells the following day. Sixteen clones were grown and prepared for screening by EcoRV digest. Two of the 16 clones showed the correct restriction digest pattern (stars, clones 4 and 8). "L" is the DNA ladder. "(−)" is a negative control, the digested core dual DEST vector by itself. "(+)" is a positive control, a digested complete Ad5 genome. (FIG. 24B) Increasing the amount of E1 entry vector improves Adsembly efficiency. An Adsembly reaction for Ad5 was performed using 20 fmol of the core dual DEST vector, 50 fmol of an E1 module entry vector and 10 fmol each of E3, and E4 module entry vectors. The reaction was carried out at room temperature overnight, and transformed into NEB 10-β cells the following day. Ten clones were grown and prepared for screening by EcoRV digest. Seven of the 10 clones showed the correct restriction digest pattern (red stars). "L" is the DNA ladder. "(−)" is a negative control, a digested Ad5 E2-E4 vector. "(+)" is a positive control, a digested complete Ad5 genome.

FIG. 26. Efficiencies in the human Ad5 AdSlicR method. Colony PCR is used as a first line of screening followed by restriction digest of PCR positive clones.

(FIG. 27A) A plaque created by a replicating Adenovirus that was assembled by Adsembly. The Adsembled genome was transfection into 293 cells, and visible plaques appeared by day 7. (FIG. 27B) Passaging and continued growth of Adsembled Ad5. Total virus from a transfection of Adsembled Ad5 was collected and re-plated onto fresh 293 cells. Clear cytopathic effect across the whole plate was visible by day 3.

FIGS. 29A-29C. FIG. 29A sets forth vectors in an Adsembly entry vector library as described herein. Ad serotypes from which the modules were derived are listed first, followed by any changes to the vector. If no changes were made, the entry is denoted "wild-type." FIG. 29B sets forth macromodule vectors for Adsembly and AdSLIC as described herein. Ad serotypes from which the macromodules were derived are listed first, followed by the modules that comprise the macromodule, followed by any changes to the vector. If there were no changes, it is denoted "wild-type." FIG. 29C sets forth Adenovirus genomes assembled using Adsembly or AdSLIC as described herein. Ad serotypes from which the genomes are based are listed first, followed by any changes to the virus. If there were no changes, it is denoted "wild-type."

(FIG. 30A) A schematic of the procedure, whereby a plasmid vector is obtained by PCR containing short (~20 bp) of homology to the ends of the viral genome to be inserted. Both the genome and vector are then treated with T4 DNA polymerase and used in SLIC as normal. (FIG. 30B) Example of the insertion of the entire Ad5 genome into a plasmid backbone. All six clones that were screened contained the entire genome. Since the genomes can insert either forward or reverse, in this case four were in one orientation (clones 1, 4, 5, and 6) and two were in the other orientation (clones 2 and 3).

FIG. 34. Top panel: Example of genome assembly of a non-human adenovirus, mouse adenovirus type 1 (SEQ ID NO: 104), using an AdSLICr system. The E1, E3-fiber, and E4 module plasmids are designed such that they can be excised with restriction enzymes that leave the exact overhang needed for sequence and ligation independent cloning (SLIC) into the linearized (with either SwaI or PmeI) core vector. This eliminates the need for PCR to obtain the linear fragment needed for SLIC, thus erasing the potential to introduce errors. It is also designed such that no foreign sequence is inserted into the final genome construct. The typical method involves excising the E3-fiber and E4 modules and combining with the PmeI-linearized core vector. This creates an E2-E4 macromodule which can then be cut with SwaI and combined with excised E1 modules to create a complete genome. Bottom panel: A wild-type mouse adenovirus type 1 was assembled using the above strategy and infectious virus forming plaques was obtained after transfection of mouse 3T6 cells.

FIG. 39. Adsembly can be used to create viruses where transgenes are expressed from the E1 module. In this case, the E1A and E1B genes of Ad5 were replaced with a GFP expression cassette in the E1 module. Virus was assembled using Adsembly, and viable GFP-expressing virus was obtained.

FIG. 40. Adsembly can be used to create viruses where transgenes are expressed from the E3 module using the natural viral transcriptional architecture. The E3 module was modified to delete the 11.6K protein (Ad5 nucleotide 29491-29772) and put mCherry in its place. The E3 transcript then naturally splices to the mCherry gene and protein is expressed. The virus was created using Adsembly, and a transduction of U2OS cells is shown. This is an example of 1) transgene expression from the E3 module, and 2) using the natural viral transcriptional architecture to express foreign genes.

FIG. 44. Fiber chimeric viruses created using Adsembly have improved transduction capacity in human embryonic stem cells (hESC) compared to the normal Ad5 fiber. Human ESC were transduced at various MOIs for 24 or 48 hours and GFP expression measured by microscopy. The top panel is a negative control with no virus. The second panel is "Ad5 CMV-GFP", which expresses GFP under the CMV promoter. On the left indicate the virus fiber chimera tested (i.e., Ad5/3 is Ad5 with the Ad3 fiber knob). All images are taken at 5× magnification.

FIG. 45. Exchange of core modules between Adenovirus serotypes produces viable virus. A core module from Ad11 was created. The Ad5 E1 and E3 modules were modified to carry the Ad11 pIX and U exon-Fiber, respectively. Whole virus was assembled using AdSLIC, and virus reconstituted on 293 cells. The base pair positions that are noted in the "final virus" list are from as set forth in SEQ ID NO: 137 (Ad5) and SEQ ID NO: 141 (Ad11).

DETAILED DESCRIPTION

Definitions

Figure 2:
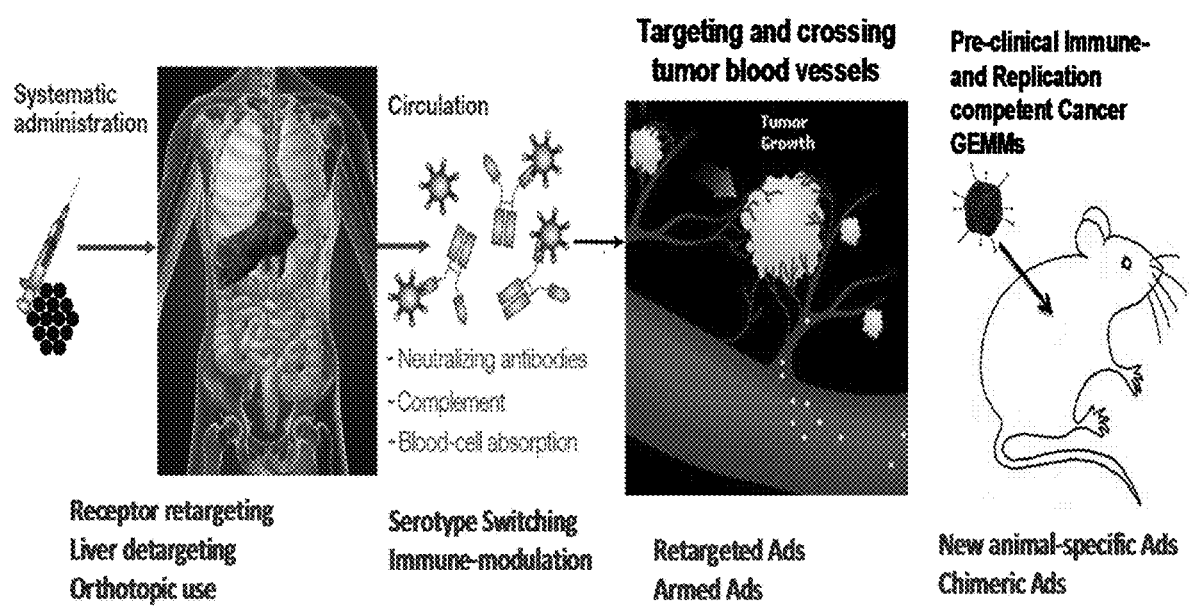
FIG. 2. Challenges that need to be overcome to further develop adenoviruses as therapeutics. A simple diagram indicating some of the major problems that need to be overcome in the field.
Figure 3:
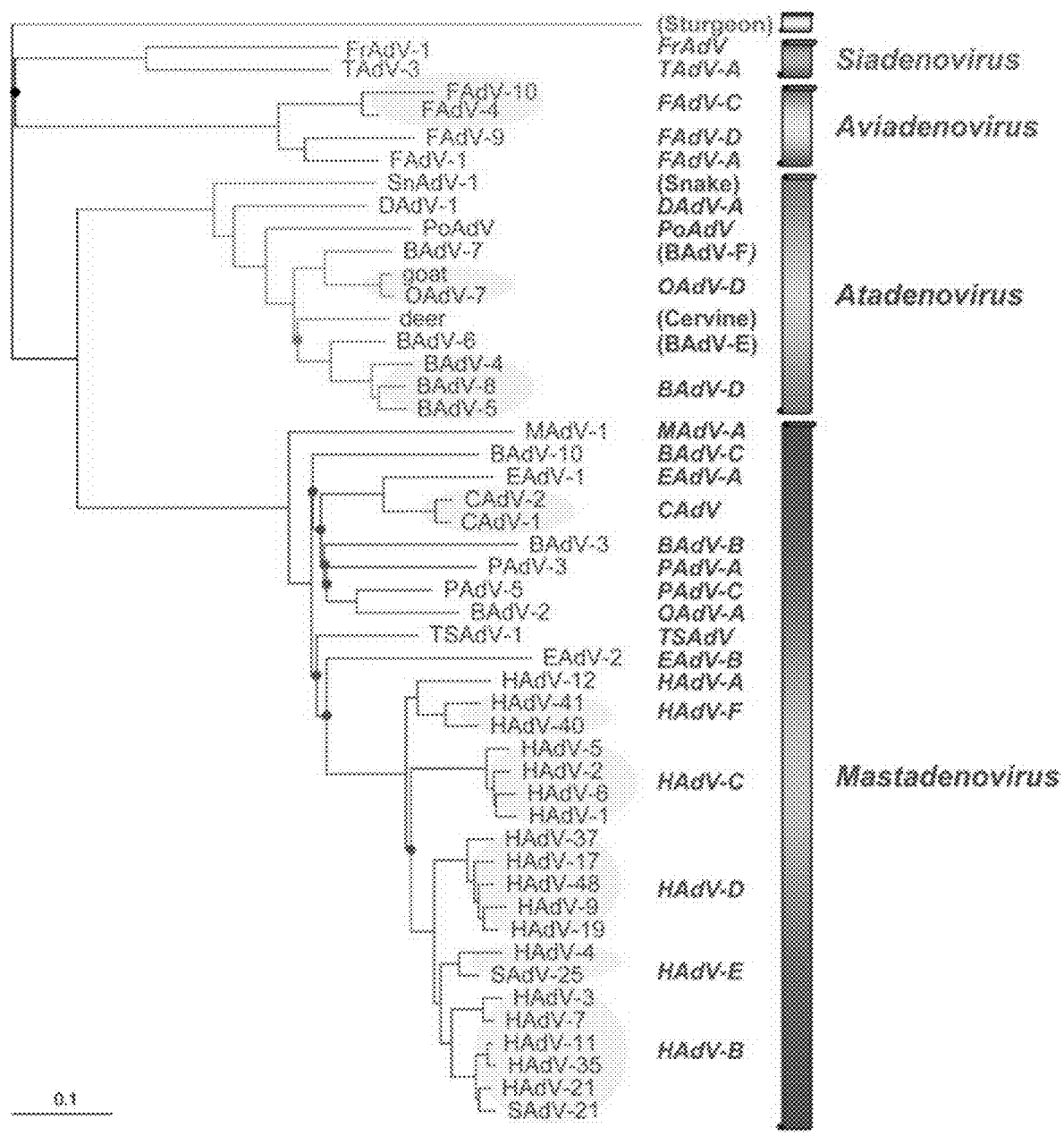
FIG. 3. A phylogenetic tree listing the four different adenovirus genera. Not all known Adenoviruses are listed. This demonstrates the variety of species in the adenovirus family.

"Nucleic acid" refers to deoxyribonucleotides or ribonucleotides and polymers thereof in either single- or double-stranded form, and complements thereof. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs).

Unless otherwise indicated, a particular nucleic acid sequence also implicitly encompasses conservatively modified variants thereof (e.g., degenerate codon substitutions) and complementary sequences, as well as the sequence explicitly indicated. Specifically, degenerate codon substitutions may be achieved by generating sequences in which the third position of one or more selected (or all) codons is substituted with mixed-base and/or deoxyinosine residues (Batzer et al., *Nucleic Acid Res.* 19:5081 (1991); Ohtsuka et al., *J. Biol. Chem.* 260:2605-2608 (1985); Rossolini et al., *Mol. Cell. Probes* 8:91-98 (1994)). The term nucleic acid is used interchangeably with gene, cDNA, mRNA, oligonucleotide, and polynucleotide.

A particular nucleic acid sequence also implicitly encompasses "splice variants." Similarly, a particular protein encoded by a nucleic acid implicitly encompasses any protein encoded by a splice variant of that nucleic acid. "Splice variants," as the name suggests, are products of alternative splicing of a gene. After transcription, an initial nucleic acid transcript may be spliced such that different (alternate) nucleic acid splice products encode different polypeptides. Mechanisms for the production of splice variants vary, but include alternate splicing of exons. Alternate polypeptides derived from the same nucleic acid by read-through transcription are also encompassed by this definition. Any products of a splicing reaction, including recombinant forms of the splice products, are included in this definition. An example of potassium channel splice variants is discussed in Leicher, et al., *J. Biol. Chem.* 273(52):35095-35101 (1998).

Construction of suitable vectors containing the desired therapeutic gene coding and control sequences may employ standard ligation and restriction techniques, which are well understood in the art (see Maniatis et al., in *Molecular Cloning: A Laboratory Manual*, Cold Spring Harbor Laboratory, New York (1982)). Isolated plasmids, DNA sequences, or synthesized oligonucleotides may be cleaved, tailored, and re-ligated in the form desired.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are near each other, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

The terms "identical" or percent "identity," in the context of two or more nucleic acids or polypeptide sequences, refer to two or more sequences or subsequences that are the same or have a specified percentage of amino acid residues or nucleotides that are the same (i.e., about 60% identity, preferably 65%, 70%, 75%, 80%, 85%, 90%, 91%, 92%, 93%, 94%, 95%, 96%, 97%, 98%, 99%, or higher identity over a specified region, when compared and aligned for maximum correspondence over a comparison window or designated region) as measured using a BLAST or BLAST 2.0 sequence comparison algorithms with default parameters described below, or by manual alignment and visual inspection (see, e.g., NCBI web site or the like). Such sequences are then said to be "substantially identical." This definition also refers to, or may be applied to, the compliment of a test sequence. The definition also includes sequences that have deletions and/or additions, as well as those that have substitutions. As described below, the preferred algorithms can account for gaps and the like. Preferably, identity exists over a region that is at least about 25 amino acids or nucleotides in length, or more preferably over a region that is 50-100 amino acids or nucleotides in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Preferably, default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequences for comparison are well-known in the art. Optimal alignment of sequences for comparison can be conducted, e.g., by the local homology algorithm of Smith & Waterman, *Adv. Appl. Math.* 2:482 (1981), by the homology alignment algorithm of Needleman & Wunsch, *J. Mol. Biol.* 48:443 (1970), by the search for similarity method of Pearson & Lipman, *Proc. Nat'l. Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., *Current Protocols in Molecular Biology* (Ausubel et al., eds. 1995 supplement)).

A preferred example of algorithm that is suitable for determining percent sequence identity and sequence similarity are the BLAST and BLAST 2.0 algorithms, which are described in Altschul et al., *Nuc. Acids Res.* 25:3389-3402 (1977) and Altschul et al., *J. Mol. Biol.* 215:403-410 (1990), respectively. BLAST and BLAST 2.0 are used, with the parameters described herein, to determine percent sequence identity for the nucleic acids and proteins of the invention. Software for performing BLAST analyses is publicly available through the National Center for Biotechnology Information, as known in the art. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4 and a comparison of both strands. For amino acid sequences, the BLASTP program uses as defaults a wordlength of 3, and expectation (E) of 10, and the BLOSUM62 scoring matrix (see Henikoff & Henikoff, *Proc. Natl. Acad. Sci. USA* 89:10915 (1989)) alignments (B) of 50, expectation (E) of 10, M=5, N=−4, and a comparison of both strands.

The terms "polypeptide," "peptide" and "protein" are used interchangeably herein to refer to a polymer of amino acid residues. The terms apply to amino acid polymers in which one or more amino acid residue is an artificial chemical mimetic of a corresponding naturally occurring amino acid, as well as to naturally occurring amino acid polymers and non-naturally occurring amino acid polymer.

The term "amino acid" refers to naturally occurring and synthetic amino acids, as well as amino acid analogs and amino acid mimetics that function in a manner similar to the naturally occurring amino acids. Naturally occurring amino acids are those encoded by the genetic code, as well as those amino acids that are later modified, e.g., hydroxyproline, γ-carboxyglutamate, and O-phosphoserine. Amino acid analogs refers to compounds that have the same basic chemical structure as a naturally occurring amino acid, i.e., an α carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. Amino acid mimetics refers to chemical compounds that have a structure that is different from the general chemical structure of an amino acid, but that functions in a manner similar to a naturally occurring amino acid.

Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes.

"Conservatively modified variants" applies to both amino acid and nucleic acid sequences. With respect to particular nucleic acid sequences, conservatively modified variants refers to those nucleic acids which encode identical or essentially identical amino acid sequences, or where the nucleic acid does not encode an amino acid sequence, to essentially identical sequences. Because of the degeneracy of the genetic code, a large number of functionally identical nucleic acids encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations," which are one species of conservatively modified variations. Every nucleic acid sequence herein which encodes a polypeptide also describes every possible silent variation of the nucleic acid. One of skill will recognize that each codon in a nucleic acid (except AUG, which is ordinarily the only codon for methionine, and TGG, which is ordinarily the only codon for tryptophan) can be modified to yield a functionally identical molecule. Accordingly, each silent variation of a nucleic acid which encodes a polypeptide is implicit in each described sequence with respect to the expression product, but not with respect to actual probe sequences.

As to amino acid sequences, one of skill will recognize that individual substitutions, deletions or additions to a nucleic acid, peptide, polypeptide, or protein sequence which alters, adds or deletes a single amino acid or a small percentage of amino acids in the encoded sequence is a "conservatively modified variant" where the alteration results in the substitution of an amino acid with a chemically similar amino acid. Conservative substitution tables providing functionally similar amino acids are well known in the art. Such conservatively modified variants are in addition to and do not exclude polymorphic variants, interspecies homologs, and alleles of the invention.

The following eight groups each contain amino acids that are conservative substitutions for one another: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and 8) Cysteine (C), Methionine (M) (see, e.g., Creighton, *Proteins* (1984)).

The term "recombinant" when used with reference, e.g., to a cell, virus, nucleic acid, protein, or vector, indicates that the cell, virus, nucleic acid, protein or vector, has been modified by the introduction of a heterologous nucleic acid or protein or the alteration of a native nucleic acid or protein, or that the cell is derived from a cell so modified. Thus, for example, recombinant cells express genes that are not found within the native (non-recombinant) form of the cell or express native genes that are otherwise abnormally expressed, under expressed or not expressed at all.

The phrase "stringent hybridization conditions" refers to conditions under which a probe will hybridize to its target subsequence, typically in a complex mixture of nucleic acids, but to no other sequences. Stringent conditions are sequence-dependent and will be different in different circumstances. Longer sequences hybridize specifically at higher temperatures. An extensive guide to the hybridization of nucleic acids is found in Tijssen, *Techniques in Biochemistry and Molecular Biology—Hybridization with Nucleic Probes*, "Overview of principles of hybridization and the strategy of nucleic acid assays" (1993). Generally, stringent conditions are selected to be about 5-10° C. lower than the thermal melting point ($T_m$) for the specific sequence at a defined ionic strength pH. The $T_m$ is the temperature (under defined ionic strength, pH, and nucleic concentration) at which 50% of the probes complementary to the target hybridize to the target sequence at equilibrium (as the target sequences are present in excess, at $T_m$, 50% of the probes are occupied at equilibrium). Stringent conditions may also be achieved with the addition of destabilizing agents such as formamide. For selective or specific hybridization, a positive signal is at least two times background, preferably 10 times background hybridization. Exemplary stringent hybridization conditions can be as following: 50% formamide, 5×SSC, and 1% SDS, incubating at 42° C., or, 5×SSC, 1% SDS, incubating at 65° C., with wash in 0.2×SSC, and 0.1% SDS at 65° C.

Nucleic acids that do not hybridize to each other under stringent conditions are still substantially identical if the polypeptides which they encode are substantially identical. This occurs, for example, when a copy of a nucleic acid is created using the maximum codon degeneracy permitted by the genetic code. In such cases, the nucleic acids typically hybridize under moderately stringent hybridization conditions. Exemplary "moderately stringent hybridization conditions" include a hybridization in a buffer of 40% formamide, 1 M NaCl, 1% SDS at 37° C., and a wash in 1×SSC at 45° C. A positive hybridization is at least twice background. Those of ordinary skill will readily recognize that alternative hybridization and wash conditions can be utilized to provide conditions of similar stringency. Additional guidelines for determining hybridization parameters are provided in numerous reference, e.g., and *Current Protocols in Molecular Biology*, ed. Ausubel, et al., John Wiley & Sons.

For PCR, a temperature of about 36° C. is typical for low stringency amplification, although annealing temperatures may vary between about 32° C. and 48° C. depending on primer length. For high stringency PCR amplification, a temperature of about 62° C. is typical, although high stringency annealing temperatures can range from about 50° C. to about 65° C., depending on the primer length and specificity. Typical cycle conditions for both high and low stringency amplifications include a denaturation phase of 90° C.-95° C. for 30 sec-2 min., an annealing phase lasting 30 sec.-2 min., and an extension phase of about 72° C. for 1-2 min. Protocols and guidelines for low and high stringency amplification reactions are provided, e.g., in Innis et al. (1990) *PCR Protocols, A Guide to Methods and Applications*, Academic Press, Inc. N.Y.).

As used herein, the term "cancer" refers to all types of cancer, neoplasm, or malignant tumors found in mammals, including leukemia, carcinomas and sarcomas. Exemplary cancers include cancer of the brain, breast, cervix, colon, head & neck, liver, kidney, lung, non-small cell lung, melanoma, mesothelioma, ovary, sarcoma, stomach, uterus and medulloblastoma. Additional examples include, Hodgkin's Disease, Non-Hodgkin's Lymphoma, multiple myeloma, neuroblastoma, ovarian cancer, rhabdomyosarcoma, primary thrombocytosis, primary macroglobulinemia, primary brain tumors, cancer, malignant pancreatic insulanoma, malignant carcinoid, urinary bladder cancer, premalignant skin lesions, testicular cancer, lymphomas, thyroid cancer, neuroblastoma, esophageal cancer, genitourinary tract cancer, malignant hypercalcemia, endometrial cancer, adrenal cortical cancer, neoplasms of the endocrine and exocrine pancreas, and prostate cancer.

The term "leukemia" refers broadly to progressive, malignant diseases of the blood-forming organs and is generally characterized by a distorted proliferation and development of leukocytes and their precursors in the blood and bone marrow. Leukemia is generally clinically classified on the basis of (1) the duration and character of the disease-acute or chronic; (2) the type of cell involved; myeloid (myelogenous), lymphoid (lymphogenous), or monocytic; and (3) the increase or non-increase in the number abnormal cells in the blood-leukemic or aleukemic (subleukemic). The P388 leukemia model is widely accepted as being predictive of in vivo anti-leukemic activity. It is believed that a compound that tests positive in the P388 assay will generally exhibit some level of anti-leukemic activity in vivo regardless of the type of leukemia being treated. Accordingly, the present invention includes a method of treating leukemia, and, preferably, a method of treating acute nonlymphocytic leukemia, chronic lymphocytic leukemia, acute granulocytic leukemia, chronic granulocytic leukemia, acute promyelocytic leukemia, adult T-cell leukemia, aleukemic leukemia, a leukocythemic leukemia, basophylic leukemia, blast cell leukemia, bovine leukemia, chronic myelocytic leukemia, leukemia cutis, embryonal leukemia, eosinophilic leukemia, Gross' leukemia, hairy-cell leukemia, hemoblastic leukemia, hemocytoblastic leukemia, histiocytic leukemia, stem cell leukemia, acute monocytic leukemia, leukopenic leukemia, lymphatic leukemia, lymphoblastic leukemia, lymphocytic leukemia, lymphogenous leukemia, lymphoid leukemia, lymphosarcoma cell leukemia, mast cell leukemia, megakaryocytic leukemia, micromyeloblastic leukemia, monocytic leukemia, myeloblastic leukemia, myelocytic leukemia, myeloid granulocytic leukemia, myelomonocytic leukemia, Naegeli leukemia, plasma cell leukemia, multiple myeloma, plasmacytic leukemia, promyelocytic leukemia, Rieder cell leukemia, Schilling's leukemia, stem cell leukemia, subleukemic leukemia, and undifferentiated cell leukemia.

The term "sarcoma" generally refers to a tumor which is made up of a substance like the embryonic connective tissue and is generally composed of closely packed cells embedded in a fibrillar or homogeneous substance. Sarcomas which can be treated with a combination of antineoplastic thiol-binding mitochondrial oxidant and an anticancer agent include a chondrosarcoma, fibrosarcoma, lymphosarcoma, melanosarcoma, myxosarcoma, osteosarcoma, Abemethy's sarcoma, adipose sarcoma, liposarcoma, alveolar soft part sarcoma, ameloblastic sarcoma, botryoid sarcoma, chloroma sarcoma, chorio carcinoma, embryonal sarcoma, Wilms' tumor sarcoma, endometrial sarcoma, stromal sarcoma, Ewing's sarcoma, fascial sarcoma, fibroblastic sarcoma, giant cell sarcoma, granulocytic sarcoma, Hodgkin's sarcoma, idiopathic multiple pigmented hemorrhagic sarcoma, immunoblastic sarcoma of B cells, lymphoma, immunoblastic sarcoma of T-cells, Jensen's sarcoma, Kaposi's sarcoma, Kupffer cell sarcoma, angiosarcoma, leukosarcoma, malignant mesenchymoma sarcoma, parosteal sarcoma, reticulocytic sarcoma, Rous sarcoma, serocystic sarcoma, synovial sarcoma, and telangiectaltic sarcoma.

The term "melanoma" is taken to mean a tumor arising from the melanocytic system of the skin and other organs. Melanomas which can be treated with a combination of antineoplastic thiol-binding mitochondrial oxidant and an anticancer agent include, for example, acral-lentiginous melanoma, amelanotic melanoma, benign juvenile melanoma, Cloudman's melanoma, S91 melanoma, Harding-Passey melanoma, juvenile melanoma, lentigo maligna melanoma, malignant melanoma, nodular melanoma, subungal melanoma, and superficial spreading melanoma.

The term "carcinoma" refers to a malignant new growth made up of epithelial cells tending to infiltrate the surrounding tissues and give rise to metastases. Exemplary carcinomas which can be treated with a combination of antineoplastic thiol-binding mitochondrial oxidant and an anticancer agent include, for example, acinar carcinoma, acinous carcinoma, adenocystic carcinoma, adenoid cystic carcinoma, carcinoma adenomatosum, carcinoma of adrenal cortex, alveolar carcinoma, alveolar cell carcinoma, basal cell carcinoma, carcinoma basocellulare, basaloid carcinoma, basosquamous cell carcinoma, bronchioalveolar carcinoma, bronchiolar carcinoma, bronchogenic carcinoma, cerebriform carcinoma, cholangiocellular carcinoma, chorionic carcinoma, colloid carcinoma, comedo carcinoma, corpus carcinoma, cribriform carcinoma, carcinoma en cuirasse, carcinoma cutaneum, cylindrical carcinoma, cylindrical cell carcinoma, duct carcinoma, carcinoma durum, embryonal carcinoma, encephaloid carcinoma, epiermoid carcinoma, carcinoma epitheliale adenoides, exophytic carcinoma, carcinoma ex ulcere, carcinoma fibrosum, gelatiniforni carcinoma, gelatinous carcinoma, giant cell carcinoma, carcinoma gigantocellulare, glandular carcinoma, granulosa cell carcinoma, hair-matrix carcinoma, hematoid carcinoma, hepatocellular carcinoma, Hurthle cell carcinoma, hyaline carcinoma, hypemephroid carcinoma, infantile embryonal carcinoma, carcinoma in situ, intraepidermal carcinoma, intraepithelial carcinoma, Krompecher's carcinoma, Kulchitzky-cell carcinoma, large-cell carcinoma, lenticular carcinoma, carcinoma lenticulare, lipomatous carcinoma, lymphoepithelial carcinoma, carcinoma medullare, medullary carcinoma, melanotic carcinoma, carcinoma molle, mucinous carcinoma, carcinoma muciparum, carcinoma mucocellulare, mucoepidermoid carcinoma, carcinoma mucosum, mucous carcinoma, carcinoma myxomatodes, nasopharyngeal carcinoma, oat cell carcinoma, carcinoma ossificans, osteoid carcinoma, papillary carcinoma, periportal carcinoma, preinvasive carcinoma, prickle cell carcinoma, pultaceous carcinoma, renal cell carcinoma of kidney, reserve cell carcinoma, carcinoma sarcomatodes, schneiderian carcinoma, scirrhous carcinoma, carcinoma scroti, signet-ring cell carcinoma, carcinoma simplex, small-cell carcinoma, solanoid carcinoma, spheroidal cell carcinoma, spindle cell carcinoma, carcinoma spongiosum, squamous carcinoma, squamous cell carcinoma, string carcinoma, carcinoma telangiectaticum, carcinoma telangiectodes, transitional cell carcinoma, carcinoma tuberosum, tuberous carcinoma, verrucous carcinoma, and carcinoma *villosum*.

By "therapeutically effective dose or amount" herein is meant a dose that produces effects for which it is administered. The exact dose and formulation will depend on the purpose of the treatment, and will be ascertainable by one skilled in the art using known techniques (see, e.g., Lieberman, *Pharmaceutical Dosage Forms* (vols. 1-3, 1992); Lloyd, *The Art, Science and Technology of Pharmaceutical Compounding* (1999); *Remington: The Science and Practice of Pharmacy,* 20th Edition, Gennaro, Editor (2003), and Pickar, *Dosage Calculations* (1999)).

The term "pharmaceutically acceptable salts" or "pharmaceutically acceptable carrier" is meant to include salts of the active compounds which are prepared with relatively nontoxic acids or bases, depending on the particular substituents found on the compounds described herein. When compounds of the present invention contain relatively acidic functionalities, base addition salts can be obtained by contacting the neutral form of such compounds with a sufficient amount of the desired base, either neat or in a suitable inert solvent. Examples of pharmaceutically acceptable base addition salts include sodium, potassium, calcium, ammonium, organic amino, or magnesium salt, or a similar salt. When compounds of the present invention contain relatively basic functionalities, acid addition salts can be obtained by contacting the neutral form of such compounds with a sufficient amount of the desired acid, either neat or in a suitable inert solvent. Examples of pharmaceutically acceptable acid addition salts include those derived from inorganic acids like hydrochloric, hydrobromic, nitric, carbonic, monohydrogencarbonic, phosphoric, monohydrogenphosphoric, dihydrogenphosphoric, sulfuric, monohydrogensulfuric, hydriodic, or phosphorous acids and the like, as well as the salts derived from relatively nontoxic organic acids like acetic, propionic, isobutyric, maleic, malonic, benzoic, succinic, suberic, fumaric, lactic, mandelic, phthalic, benzenesulfonic, p-tolylsulfonic, citric, tartaric, methanesulfonic, and the like. Also included are salts of amino acids such as arginate and the like, and salts of organic acids like glucuronic or galactunoric acids and the like (see, e.g., Berge et al., *Journal of Pharmaceutical Science* 66:1-19 (1977)). Certain specific compounds of the present invention contain both basic and acidic functionalities that allow the compounds to be converted into either base or acid addition salts. Other pharmaceutically acceptable carriers known to those of skill in the art are suitable for the present invention.

Detailed Embodiments

I. Adsembly Methods

In one aspect, a method is provided for making a recombinant adenovirus (also referred to herein as "Adsembly"). The method includes assembling a nucleic acid from two or more adenoviral gene modules selected from an E1 module, an E2-L2 module, an L3-L4 module, an E3 module, an E4 module, or an adenoviral macromodule (or mutant thereof as described below). In some embodiments, the method includes assembling the nucleic acid from three, four or five adenoviral gene modules selected from an E1 module, an E2-L2 module, an L3-L4 module, an E3 module, an E4 module or an adenoviral macromodule. The nucleic acid may be an adenovirus genome construct. An adenovirus genome construct is a nucleic acid that, when expressed (e.g. upon introduction into a mammalian cell) is capable of forming a recombinant adenovirus. The nucleic acid may also be a partial adenovirus genome construct which, together with an additional virus (e.g. a helper virus) is capable of forming a recombinant adenovirus when expressed (e.g. upon introduction into a mammalian cell). The adenoviruses so formed may be replicated and packaged to give rise to progeny viruses. Thus, the methods provided herein may include assembling an adenoviral genome in vitro from two or more genomic modules or heterologous elements that upon transfection into mammalian cells, either alone, in a complementing cell-line, or together with a helper virus, is replicated and packaged to give rise to progeny viruses. Genomic modules may be selected based on evolutionarily conserved sequences, transcriptional or functional units. In some embodiments, the method includes assembling the nucleic acid from three or more adenoviral gene modules selected from an E1 module, an E2-L2 module, an L3-L4 module, an E3 module, and an E4 module. The resulting nucleic acid (also referred to herein as an "assembled nucleic acid") may be expressed after assembly (e.g. replicated, transcribed, translated, and packaged) thereby forming a recombinant adenovirus. The expression of the nucleic acid may be performed in vitro, in situ, in a cell (e.g. by transfecting the nucleic acid into a cell), or in vivo. In certain embodiments, the expression is performed in a cell thereby leading to virus production.

The term "adenoviral gene module," as used herein, refers to an E1 module, an E2-L2 module, an L3-L4 module, an E3 module, an E4 module or a macromodule thereof. An adenoviral gene module is, therefore, a nucleic acid (e.g. DNA). A "individual adenoviral gene module," as used herein, refers to an E1 module, an E2-L2 module, an L3-L4 module, an E3 module, or an E4 module. In some embodiments, one or more of the individual adenoviral gene modules may be assembled from smaller submodules prior to assembling the nucleic acid. An adenoviral macromodule is the combination of two, three or four of an E1 module, an E2-L2 module, an L3-L4 module, an E3 module, an E4 module. The macromodule, therefore, is a linear strand of nucleic acid (e.g. DNA) that includes two, three or four of an E1 module, an E2-L2 module, an L3-L4 module, an E3 module, an E4 module. The term "adenoviral macromodule," as used herein, refers to:

- an E1-L2 macromodule (i.e. a nucleic acid including an E1 module and an E2-L2 module combined);
- an E1-L4 macromodule (i.e. a nucleic acid including an E1 module, an E2-L2 module and an L3-L4 module combined);
- an E1-E3 macromodule (i.e. a nucleic acid including an E1 module, an E2-L2 module, an L3-L4 module and an E3 module combined);
- an E2-L4 macromodule (i.e. a nucleic acid including an E2-L2 module and an L3-L4 module, also referred to herein as a "core macromodule");
- an E2-E3 macromodule (i.e. a nucleic acid including an E2-L2 module, an L3-L4 module and an E3 module combined);
- an E2-E4 macromodule (i.e. a nucleic acid including an E2-L2 module, an L3-L4 module, an E3 module and an E4 module combined);
- an L3-E3 macromodule (i.e. a nucleic acid including an L3-L4 module, and an E3 module combined) an L3-E4 macromodule (i.e. a nucleic acid including an L3-L4 module, an E3 module and an E4 module combined); and
- an E3-E4 macromodule (i.e. a nucleic acid including an E3 module and an E4 module combined).

In some embodiments, the adenoviral macromodule is an E2-L4 macromodule (i.e. a core macromodule) or an E3-E4 macromodule. Where an adenoviral macromodule is used as one of the two or more selected adenoviral modules for assembling the nucleic acid, the other selected adenoviral module(s) is/are not an individual adenoviral gene module contained within that adenoviral macromodule. In other words, each individual adenoviral gene module is present only once in the assembled nucleic acid, whether separately or within a macromodule. For example, where one of the two or more selected adenoviral gene modules for assembling the nucleic acid is the core macromodule, neither the E2-L2 nor L3-L4 modules are selected as another module for inclusion in the assembled nucleic acid. Likewise, where three or more adenoviral gene modules are selected, the adenoviral macromodule is not an E1-E3 macromodule or E2-E4 macromodule.

In some embodiments, the method includes assembling the nucleic acid from three adenoviral gene modules selected from (i) an E1 module, (ii) a core macromodule, and (iii) an E3 module, an E4 module or an E3-E4 macromodule. The method may also include assembling the nucleic acid from four adenoviral gene modules selected from an E1 module, a core macromodule, an E3 module, and an E4 module.

In some embodiments, one or more adenoviral gene modules may be combined to form a macromodule prior to assembling the nucleic acid. Where a macromodule is formed, the method includes assembling the nucleic acid from a macromodule and one or more individual adenoviral gene modules not included within the macromodule (i.e. an E1 module, an E2-L2 module, an L3-L4 module, an E3 module, and/or an E4 module). In some embodiments, the macromodule is a core macromodule. Thus, in some embodiments, the method includes assembling the nucleic acid using the core macromodule and one or more adenoviral gene modules selected from the E1 module, the E3 module, or the E4 module.

Figure 5:
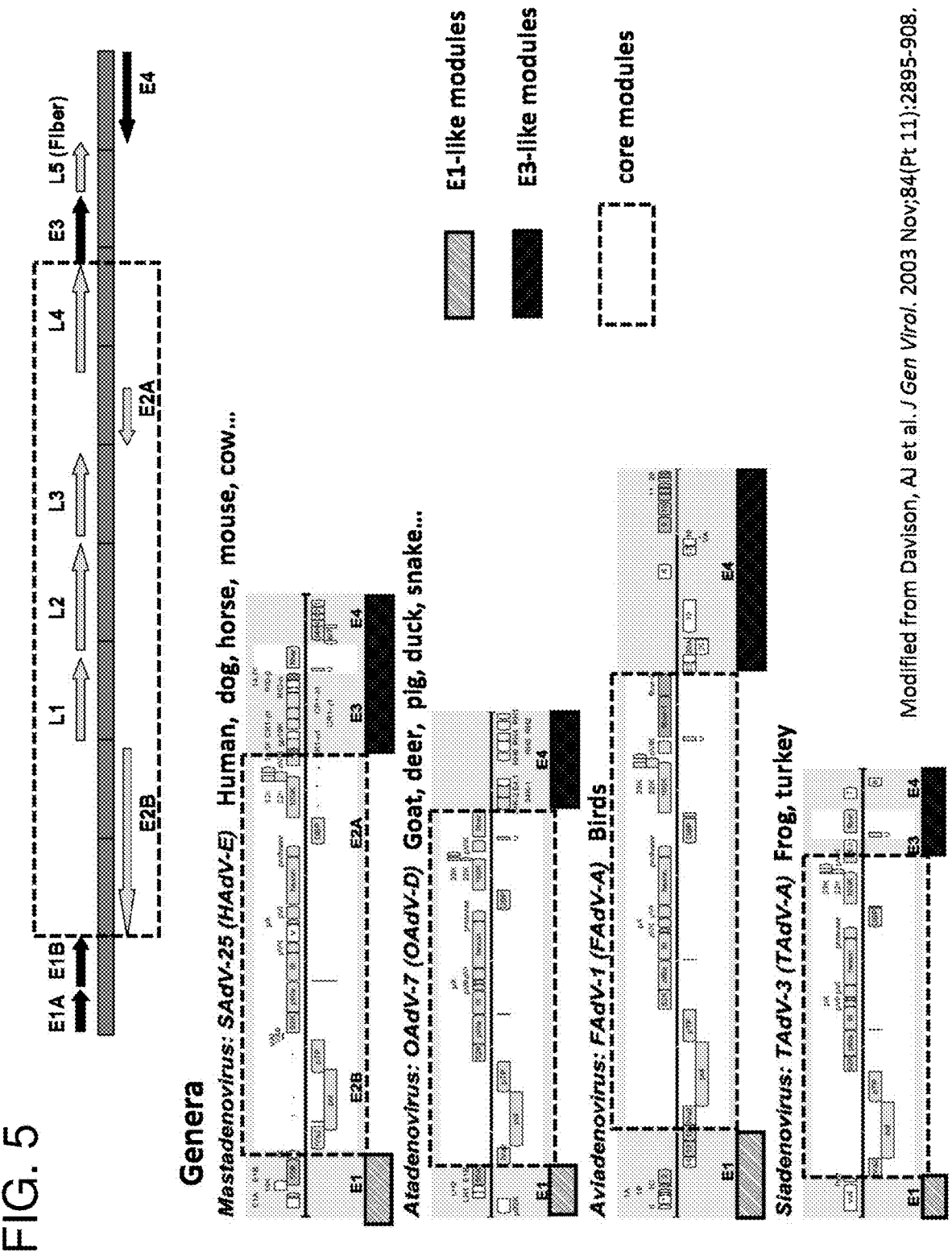
FIG. 5. Conservation of a "core" genomic region across adenovirus genera. The top of the figure is a simplified map of the human Ad5 genome (SEQ ID NO: 137), with the core region highlighted in dashed box. This core region is conserved throughout all adenovirus genera, as indicated by the white boxes around the genes in the bottom figure. All genera share this core region, with almost all of the core open reading frames present from the IVa2 (left end) through the pVIII (right end). The genomic variability lies at the ends of the genomes. Applicants have divided our module names into an E1 module (also referred to herein as a E1-like module) (everything left of the core, denoted by a bar), a core module (denoted by a bar), and an E3 module (also referred to herein as an E3-like module) (everything to the right of the core, denoted by a bar), since the content of the modules will vary somewhat between species, but their position relative to the core will not. In some cases, the fiber protein is immediately next to the core, while in others (human Ads) it is outside the core.
Figure 6:
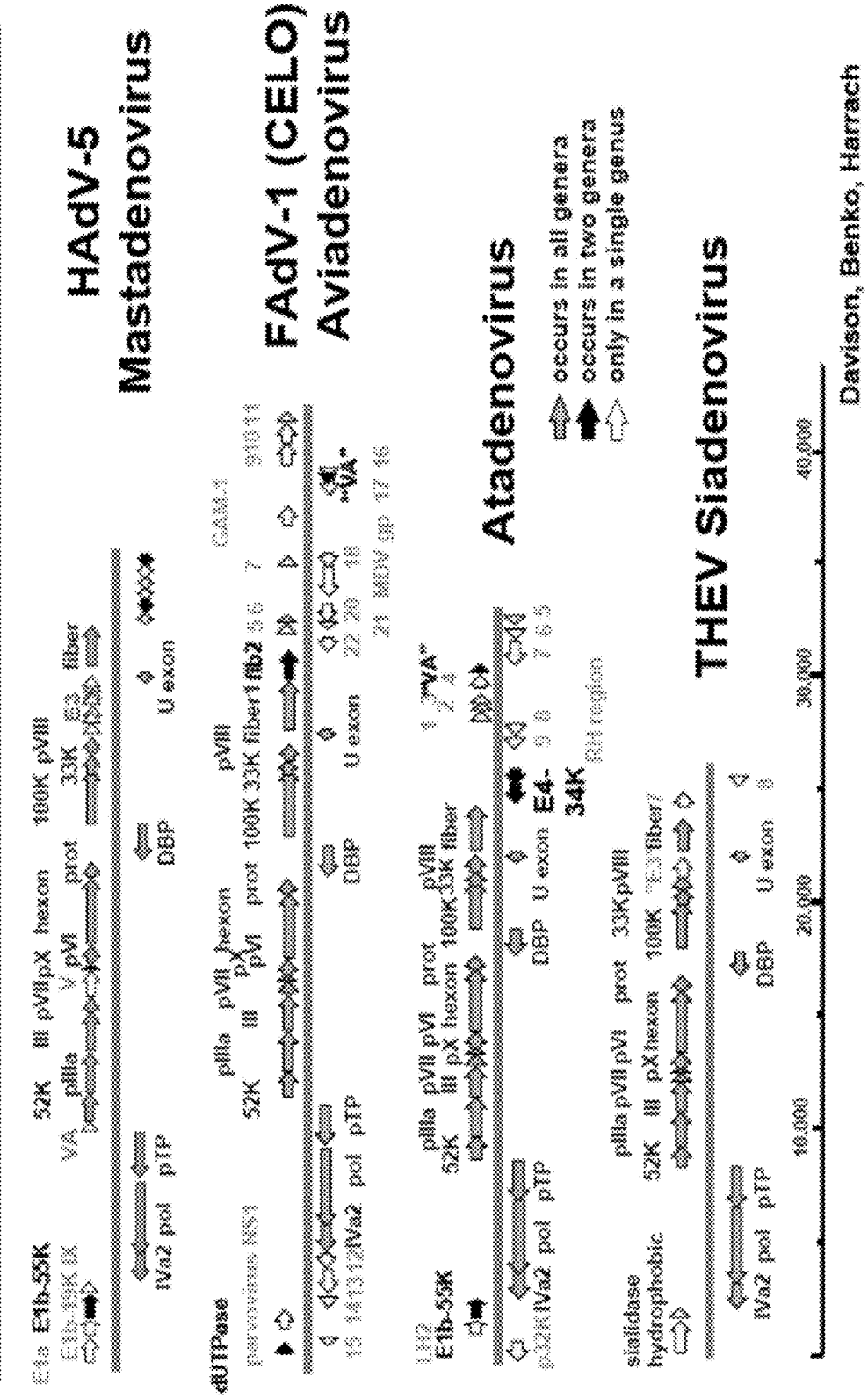
FIG. 6. Transcriptional maps from various adenovirus genera showing conservation of transcriptional units across adenovirus species. Core genes are shown, as are genes found in one or two genera. This figure provides a view of the variability at the ends of the genomes between genera. "Davison, Benko, Harrach" as recited herein refers to Benko M et al., (2005) Family Adenoviridae. Fauquet C M, Mayo M A, Maniloff J, Desselberger U, Ball L A (eds): Virus Taxonomy. VIIIth Report of the International Committee on Taxonomy of Viruses. Elsevier, New York pp 213-228.

Adenoviruses are non-enveloped, icosahedral viruses that replicate in the nucleus. The adenoviral gene modules provided herein refer to certain positions in adenoviral genomes, as described, for example, in Davison et al., *Journal of General Virology*, (2003), 84, 28695-2938. In some embodiments, the adenoviral gene modules are derived from a human adenovirus. FIG. 5 is a simplified map of human Ad5 showing the adenoviral gene modules provided herein as well as their approximate size in kilobases (kb). Each module may encode multiple gene products and alternative gene splicing arrangements.

An "E1 module," as used herein, is a nucleic acid containing an adenoviral inverted terminal repeat (ITR). The E1 module may additionally include a promoter that may be operably linked to a protein coding region of the assembled nucleic acid. The E1 module is typically derived from the adenoviral E1A and/or E1B regions. In addition to the ITR region, the E1 module may also include any of the viral genes found from the E1 terminus of an adenoviral genome to the viral polymerase coding region (discussed below). For example, the E1 module may additionally include coding regions for the major transcriptional activator E1A (e.g. encoding inactivators of the pRB family), E1B-19K (e.g. encoding apoptosis blockers), E1B 55K (e.g. p53 binding, mre binding and viral mRNA exporters) and/or pIX (e.g. encoding minor structural proteins and proteins that interact with Hexon on the viral capsid). The E1 module may be approximately 4 kb, 3 kb, 2 kb or 1 kb in length. In some embodiments, the E1 module is approximately the same size in length as the E1A and E1B regions of an adenovirus found in nature (e.g. see FIG. 5).

An "E2-L2" module, as used herein, is a nucleic acid containing at least one of a viral DNA polymerase coding region and a hexon protein coding region. In some embodiments, the E2-L2 module also include a viral DNA-binding protein coding region. The E2-L2 module is typically derived from the adenoviral E2B, L1 and/or L2 regions. The E2-L2 module may additionally include coding regions for E2B IVa2 (e.g. encoding late transcription activators and proteins that assist in packaging viral DNA into the viral capsid), E2B Pol (e.g. encoding viral DNA polymerases), E2B pTP (e.g. encoding the terminal protein that attach to the ends of viral genomes and is necessary for viral replication and packaging), L1 52K (e.g. encoding proteins necessary for packaging viral DNA into capsids), L1 IIIa (e.g. encoding minor structural proteins that help to stabilizes the capsid), L2 III (penton) (e.g. encoding major structural proteins that form the vertex of the capsid where the fiber protrudes), L2 pVII (e.g. encoding core structural proteins with homology to histone H3 and associate with viral DNA in the capsid), L2 V (e.g. encoding core structural proteins that forms the association between DNA and the viral capsid), and L2 pX (e.g. encoding core structural protein that bind to and condense the viral genome). In some embodiments, the E2-L2 module is approximately the same size in length as the E2B, L1 and L2 regions of an adenovirus found in nature (e.g. see FIG. 5).

An "L3-L4" module, as used herein, is a nucleic acid containing at least one of a viral DNA polymerase coding region and a hexon protein coding region. In some embodiments, the L3-L4 module may also include a viral DNA-binding protein coding region. In some embodiments, where the E2-L2 module contains a viral DNA polymerase coding region, the L3-L4 does not contain a viral DNA coding regions and vice versa. Likewise, where the E2-L2 module contains a hexon protein coding region, the L3-L4 may not contain a hexon protein coding region and vice versa. Similarly, where he E2-L2 module contains a viral DNA-binding protein coding region, the L3-L4 may not contain a viral DNA-binding protein coding region and vice versa. In other words, the viral DNA polymerase coding region, the hexon protein coding region, and the viral DNA-binding protein coding region typically appear only once in the assembled nucleic acid. The L3-L4 module may also include coding regions for L3 pVI (e.g. encoding a minor structural proteins that form an association between the capsid and the viral genomic DNA at the vertices), L3 II (hexon) (e.g. encoding major structural proteins that form the triangular faces of the capsid), L3 23K (e.g. encoding viral proteases that processes viral proteins to complete capsid assembly), E2A DBP (e.g. encoding DNA binding proteins that binds viral DNA and facilitates replication), L4 100K (e.g. encoding proteins that inhibit cellular protein synthesis and promote translation of viral late proteins), L4 33K (e.g. encoding proteins that promote splicing of late viral genes), one or more fiber proteins, and L4 22K (e.g. encoding proteins that promotes late viral gene expression and aid in viral DNA packaging). In some embodiments, the L3-L4 module is approximately the same size in length as the L3, E2A and L4 regions of an adenovirus found in nature or the L3, E2A, L4 and L5 regions of an adenovirus found in nature (e.g. see FIG. 5).

A "core macromodule" (also referred to herein as an "E2-L4 macromodule"), as used herein, refers to a nucleic acid containing at least one of a viral DNA polymerase coding region and a hexon protein coding region. In some embodiments, the core macromodule may also include a viral DNA-binding protein coding region. In some embodiment, the core macromodule includes most of the viral structural proteins as well as those necessary for DNA replication and packaging. In some embodiments, it includes a viral DNA polymerase coding region, a hexon protein coding region and a viral DNA polymerase coding region. In other embodiments, the core may also include coding regions for L3 pVI (e.g. encoding a minor structural proteins that form an association between the capsid and the viral genomic DNA at the vertices), L3 II (hexon) (e.g. encoding major structural proteins that form the triangular faces of the capsid), L3 23K (e.g. encoding viral proteases that processes viral proteins to complete capsid assembly), E2A DBP (e.g. encoding DNA binding proteins that binds viral DNA and facilitates replication), L4 100K (e.g. encoding proteins that inhibit cellular protein synthesis and promote translation of viral late proteins), L4 33K (e.g. encoding proteins that promote splicing of late viral genes), and L4 22K (e.g. encoding proteins that promotes late viral gene expression and aid in viral DNA packaging), E2B IVa2 (e.g. encoding late transcription activators and proteins that assist in packaging viral DNA into the viral capsid), E2B Pol (e.g. encoding viral DNA polymerases), E2B pTP (e.g. encoding the terminal protein that attach to the ends of viral genomes and is necessary for viral replication and packaging), L1 52K (e.g. encoding proteins necessary for packaging viral DNA into capsids), L1 IIIa (e.g. encoding minor structural proteins that help to stabilizes the capsid), L2 III (penton) (e.g. encoding major structural proteins that form the vertex of the capsid where the fiber protrudes), L2 pVII (e.g. encoding core structural proteins with homology to histone H3 and associate with viral DNA in the capsid), L2 V (e.g. encoding core structural proteins that forms the association between DNA and the viral capsid), one or more fiber proteins, and L2 pX (e.g. encoding core structural protein that bind to and condense the viral genome). In some embodiments, the L3-L4 module is approximately the same size in length as the E2B, L1, L2, L3, E2A and L4 regions of an adenovirus found in nature or the E2B, L1, L2, L3, E2A, L4 and L5 regions of an adenovirus found in nature (e.g. see FIG. 5).

The protein encoded by the viral DNA polymerase gene contains sequence that shares at least 45% (e.g. 50%, 60%, 70%, 80%, 90%, 91%, 92%, 93%, 94%, 95%, 96%, 97%, 98%, 99% or 100%) identity to at least 50 contiguous amino acids (e.g. all) of amino acids 996-1103 of the human Ad5 DNA polymerase as set forth in SEQ ID NO: 32 (FIG. 7A-C) or homolog thereof derived from another species. The protein encoded by the hexon gene contains sequence that shares at least 45% (e.g. 50%, 60%, 70%, 80%, 90%, 91%, 92%, 93%, 94%, 95%, 96%, 97%, 98%, 99% or 100%) identity to at least 50 contiguous amino acids (e.g. all) of amino acids 501-747 of the human Ad5 hexon as set forth in SEQ ID NO: 73 (FIG. 7D-G) or homolog thereof derived from another species. The protein encoded by the viral DNA-binding protein gene contains sequence that shares at least 35% (e.g. 45%, 50%, 60%, 70%, 80%, 90%, 91%, 92%, 93%, 94%, 95%, 96%, 97%, 98%, 99% or 100%) identity to at least 50 contiguous amino acids (e.g. all) of amino acids 408-475 of the human Ad5 DNA-binding protein as set forth in SEQ ID NO:103 (FIG. 7H-I) or homolog thereof derived from another species.

An "E4 module," as used herein, is a nucleic acid containing is a nucleic acid containing an adenoviral inverted terminal repeat (ITR). In some embodiments, the E4 additionally includes a coding region for one or more fiber proteins. The E4 module may additionally include coding regions for E4 orf 6/7 (e.g. encoding proteins that mediate E2F trans activation of viral transcription), E4 orf 6 (e.g. encoding proteins that promote viral DNA synthesis, stabilize and export viral late mRNAs, and promote splicing), E4 orf4 (e.g. encoding proteins that regulates viral transcription and splicing, and modulate PP2A), E4 orf3 (e.g. encoding proteins that block p53-mediated transcription, disrupt MRN DNA-repair complex, and prevent concatemerization), E4 orf2, and E4 orf1 (e.g. encoding proteins that promotes signaling through PI3-kinase thereby leading to protein synthesis and cell survival). In some embodiments, the E4 module is approximately the same size in length as the E4 region of an adenovirus found in nature or the E4 and L5 regions of an adenovirus found in nature (e.g. see FIG. 5).

An "E3 module," as used herein, is a nucleic acid containing is a nucleic acid containing a coding region for one or more fiber proteins and/or an adenoviral inverted terminal repeat (ITR). In some embodiments, the E3 module includes of any known adenoviral sequence from the end of the protein coding region of pVIII to the ITR located at the right terminus of the genome (as shown in FIG. 5). The pVIII coding region is any gene that encodes a protein that contains sequence sharing at least 35% (e.g. 50%, 60%, 70%, 80%, 90%, 91%, 92%, 93%, 94%, 95%, 96%, 97%, 98%, 99% or 100%) identity to at least 50 contiguous amino acids (e.g. all) of amino acids 6-43 of the human Ad5 pVIII protein as set forth in SEQ ID:135 (FIG. 7J). The E3 module may additionally include coding regions for L4 pVIII (e.g. encoding a minor structural protein) E3 12.5K, E3 CR1α (e.g. encoding proteins that blocks apoptosis), E3 gp19K (e.g. encoding immunomodulatory proteins that inhibit MHC-I antigen presentation), E3 ADP (e.g. encoding proteins that functions to efficiently lyse the cell for virus release), E3 RIDα (e.g. encoding immunomodulatory proteins that removes the pro-apoptotic FasL and TRAIL from cell surface), E3 RIDβ—(e.g. encoding immunomodulatory proteins that remove the pro-apoptotic FasL and TRAIL from cell surface), E3 14.7K (e.g. encoding proteins that block apoptosis), and L5 IV (Fiber) (e.g. encoding major structural protein that extend from the penton base and are responsible for receptor binding). In some embodiments, the E3 module is approximately the same size in length as the E3 region of an adenovirus found in nature or the E3 and L5 regions of an adenovirus found in nature (e.g. see FIG. 5).

An "E3-E4 macromodule," as used herein, is a nucleic acid including an adenoviral inverted terminal repeat (ITR). The E-3-E4 macromodule may additionally include any known adenoviral sequence from the end of the protein coding region of pVIII to the ITR located at the right terminus of the genome (as shown in FIG. 5). The E3-E4 macromodule may additionally include coding regions for E4 orf 6/7 (e.g. encoding proteins that mediate E2F transactivation of viral transcription), E4 orf 6 (e.g. encoding proteins that promote viral DNA synthesis, stabilize and export viral late mRNAs, and promote splicing), E4 orf4 (e.g. encoding proteins that regulates viral transcription and splicing, and modulate PP2A), E4 orf3 (e.g. encoding proteins that block p53-mediated transcription, disrupt MRN DNA-repair complex, and prevent concatemerization), E4 orf2, E4 orf1 (e.g. encoding proteins that promotes signaling through PI3-kinase thereby leading to protein synthesis and cell survival), L4 pVIII (e.g. encoding a minor structural protein) E3 12.5K, E3 CR1α (e.g. encoding proteins that blocks apoptosis), E3 gp19K (e.g. encoding immunomodulatory proteins that inhibit MHC-I antigen presentation), E3 ADP (e.g. encoding proteins that functions to efficiently lyse the cell for virus release), E3 RIDα (e.g. encoding immunomodulatory proteins that removes the pro-apoptotic FasL and TRAIL from cell surface), E3 RIDβ—(e.g. encoding immunomodulatory proteins that remove the pro-apoptotic FasL and TRAIL from cell surface), E3 14.7K (e.g. encoding proteins that block apoptosis), and L5 IV (Fiber) (e.g. encoding major structural protein that extend from the penton base and are responsible for receptor binding).

In some embodiments, one or more of the adenoviral gene modules include one or more mutations (e.g. substitution, addition or deletion of a nucleic acid) relative to the sequence of the module found in the natural (e.g. wild type) adenovirus from which the adenoviral gene module is derived. For example, the nucleic acid provided herein may encode a sufficient number of adenoviral gene modules such that, under certain cellular conditions, transfection of the nucleic acid into a cell results in the formation of a replication competent adenovirus. The mutation in one or more of the adenoviral gene modules may allow the resulting adenovirus to replicate in some cells (e.g. diseased cells such as cancer cells) but not replicate in other cells (e.g. non-diseased cells such as healthy cells). The mutation may also include the addition of one or more protein coding regions (e.g. the addition of one or more exogenous or heterologous protein coding region such as a non-viral protein coding region). The addition of one or more proteins may provide additional viral functionality, loss of a viral functionality (e.g. replication), provide for a method of virus detection (e.g. a fluorescent marker), provide for a method of virus purification (e.g. a H is tagged capsid protein), or provide a virus capable of producing a protein of interest that is subsequently isolated and/or purified for further use. Thus, the mutation may add a viral function or subtract a viral function. The recombinant adenoviruses produced herein, therefore, include adenoviruses that have been modified by the introduction of an exogenous (e.g. heterologous) nucleic acid or the alteration of the native nucleic acid sequence. The alteration may be through a mutation in one or more of the adenoviral gene modules as described above, or by the exclusion of one or more of the adenoviral gene modules present in the native adenoviral genome.

Thus, in some embodiments, the nucleic acid includes a mutated adenoviral nucleic acid sequence. An adenoviral nucleic acid sequence is a sequence found in a natural or native adenovirus (e.g. wild type). The mutated adenoviral nucleic acid sequence may result from a mutation in one or more of the adenoviral gene modules as described above, or by the exclusion of one or more of the adenoviral gene modules present in the native adenoviral genome. In certain embodiments, the nucleic acid includes a deleted adenoviral nucleic acid sequence, an ectopic adenoviral nucleic acid sequence, or an exogenous (e.g. heterologous) nucleic acid sequence (e.g. encoding a non-adenoviral gene product). The mutated adenoviral nucleic acid sequence may include a mutated E4-ORF3 gene product that confers altered functionality, a mutated E1B-55k gene product, a mutated adenoviral fiber gene product, a mutated viral coat protein, a pro-drug converting enzyme, a reporter protein, a mutated hexon protein, a protein fused to pIX, a protein toxic to certain cells, a complete or partial fiber gene from an adenovirus other than that type where the nucleic acid is obtained, and/or a targeting protein (e.g. a tumor-targeting protein or a vasculature-targeting protein).

In some embodiments, the nucleic acid includes the E1 module. The nucleic acid may also include both the E1 module and the E4 modules. In certain embodiments, the nucleic acid includes the E1 module and the E2-L2 module. The nucleic acid may also include the E1 module and the L3-L4 module. The nucleic acid may also include the E1 module, the E2-L2 module and the L3-L4 module.

In some embodiments, the method includes assembling the nucleic acid from at least three adenoviral gene modules selected from an E1 module, a core module, an E3 module, and/or derivations or components thereof. In related embodiments, for the example of human Ad5, the method includes assembling the nucleic acid from an E1 module, an E2-L2 module, an L3-L4 module, an E3 module, and an E4 module. In certain embodiments, the nucleic acid formed is at least 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 kb in length. In some embodiments, the nucleic acid formed is at least 10, 11, 12, 13, 14, 15, 16, 17, 18, 19, 20, 21, 22 kb in length. In some embodiments, the nucleic acid formed is at least 10, 11, 12, 13, 14, 15 kb in length. In some embodiments, the nucleic acid formed is at least 10, 11, 12 kb in length. In some embodiments, the nucleic acid formed is at least 12 kb in length.

The nucleic acid formed by the methods provided herein may be any expressible nucleic acid. The nucleic acid may be expressed to produce an adenovirus. The adenovirus may be infectious and/or self-replicable (e.g. replication competent). In some embodiments, the nucleic acid is a plasmid.

Figure 9:
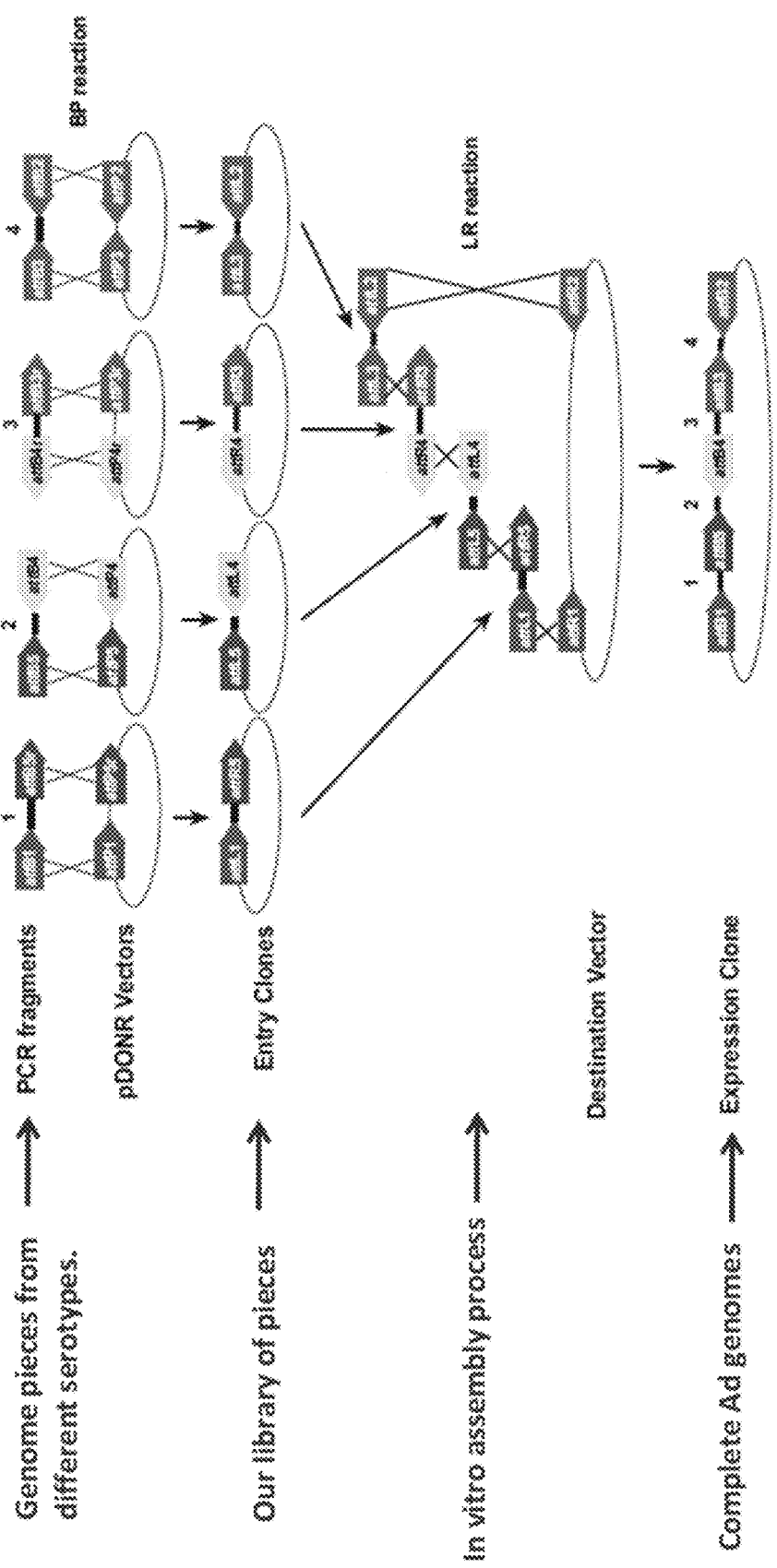
FIG. 9. A simple diagram of an example of multisite gateway using four DNA fragments. Multisite gateway was our proposed system to reassemble genomes. On the left is a proposed system.

In some embodiments, the assembling includes combining the adenoviral gene modules (or macromodules)

together to form the nucleic acid, wherein the orientation of the adenovirus modules or macromodules is conducive to form a replicable adenovirus upon introduction into a cell (e.g. expression or formation of the virus in the cell). Thus, in some embodiments, the adenoviral gene modules (e.g. macromodules) are assembled in an orientation specific manner. Any applicable cloning techniques may be employed, including, for example the so-called "gateway" technology and/or the sequence and ligation independent cloning technology ("SLIC"). The gateway technology or similar technology employs site specific recombination to exchange nucleic acid (e.g. DNA) fragments from one piece of nucleic acid to another. The net result is insertion of a nucleic acid sequence into a destination vector or plasmid. These technologies and methods are collectively referred to herein as "site specific recombination methods" or "SSR methods." In one such application of an SSR method, DNA fragments are moved from an entry vector into a destination vector, the result of which is the allowed propagation of the destination vector (FIG. 9). Entry vectors and destination vectors typically contain recombination sites. In some embodiments, entry vectors are recombination competent. In other embodiments, entry vectors are hybridization competent. Hybridization competent entry vectors may contain one or more adenoviral gene modules, which can be released from the entry vector by enzymatic restriction, thereby releasing the adenoviral gene modules. Provided herein are SSR methods adapting the gateway technology for insertion of adenoviral gene modules into a destination vector to form the nucleic acid (e.g. a nucleic acid plasmid). General methods of using the gateway technology is described, for example, in Sone et. al., *J Biotechnol.* (2008) September 10; 136(3-4):113-21; Hartley, et al., *Genome Res.* (2000), 10, 1788-1795; and Sasaki, et al., *J. Biotechnol.* (2004), 107, 233-243.

For example, where an SSR method is used, the assembling includes contacting a recombination competent destination vector (e.g. a destination vector including a recombination site nucleic acid sequence) and one or more of the adenoviral gene modules with an integrase (e.g. lambda phage integrase, lambda phage excisionase, or the bacterial host integration factor) thereby forming an adenoviral gene module vector. The one or more of the adenoviral gene modules are recombination competent adenoviral gene modules (e.g. an adenoviral gene module including a recombination site nucleic acid sequence). In some embodiments, the one or more recombination competent adenoviral gene modules are formed by adding a recombination site nucleic acid sequence to an adenoviral gene module thereby forming the one or more recombination competent adenoviral gene modules. In other embodiments, the one or more recombination competent adenoviral gene modules are part of a recombination competent entry vector. In some embodiments, the recombination competent entry vectors containing one or more of the adenoviral gene modules are formed by contacting one or more recombination competent adenoviral gene modules and a recombination competent donor vector with an integrase, thereby forming the recombination competent entry vectors containing one or more of the adenoviral gene modules. Thus, in some embodiments, a recombination competent destination vector and one or more recombination competent entry vectors containing one or more of the adenoviral gene modules are contacted with an integrase activity, thereby forming an adenoviral gene module vector.

Figure 20:
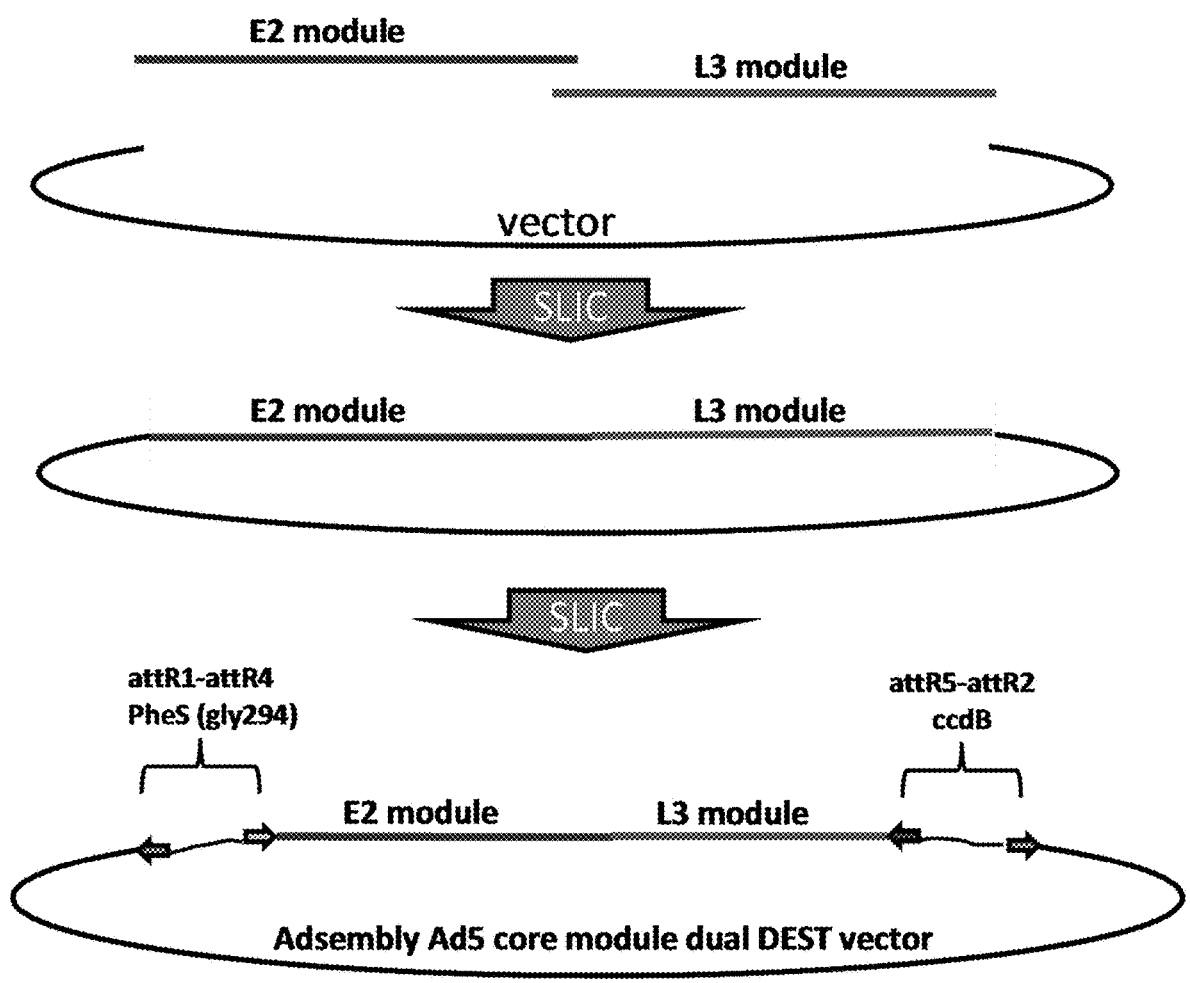
FIG. 20. Creation of the human Ad5 Adsembly dual DEST vector. The E2 and L3 modules are obtained by PCR from their respective entry vectors and are combined with a vector backbone using SLIC. Subsequently, gateway counterselection cassettes are inserted flanking the modules by SLIC after digesting the vector with unique restriction sites engineered at the ends of the modules.
Figure 21:
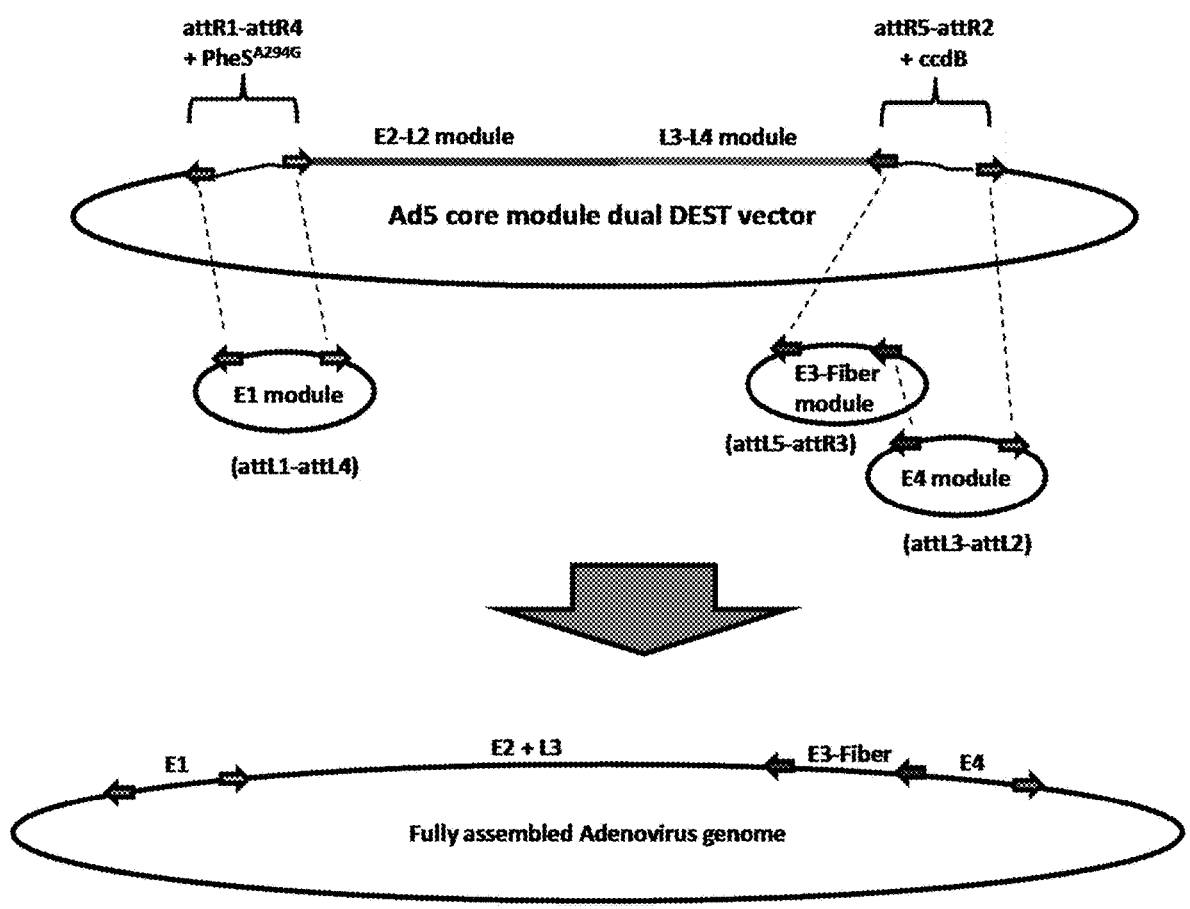
FIG. 21. An Adsembly process for human Ad5. The core module dual DEST vector is combined with one of each of the remaining 3 entry vectors in a gateway LR reaction to reassemble a complete viral genome.
Figure 23:
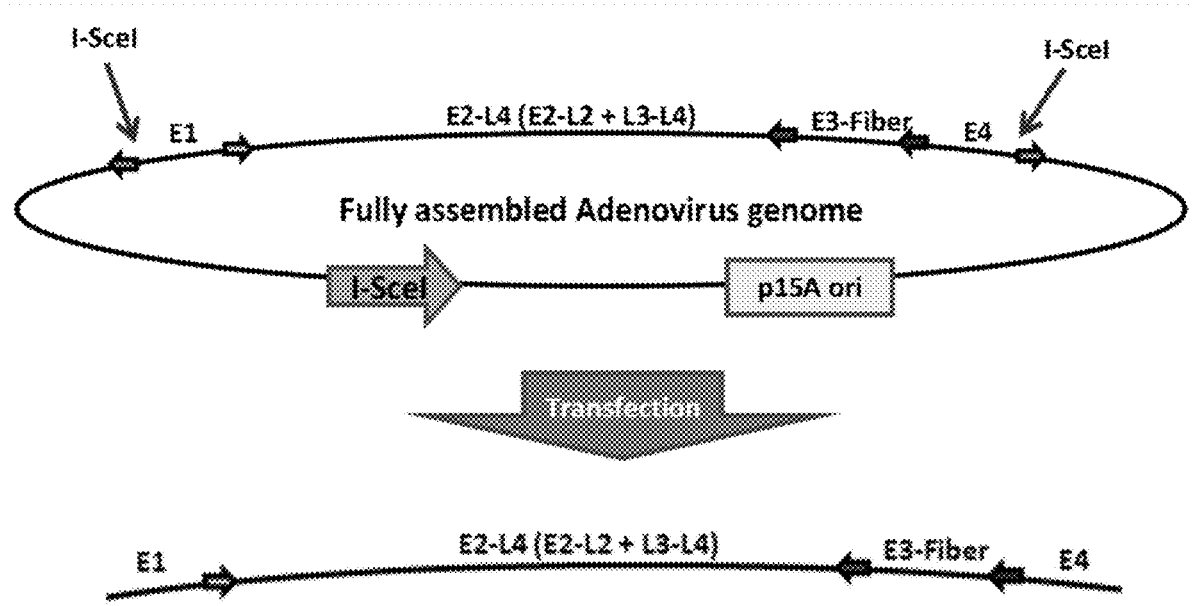
FIG. 23. An Adsembly vector backbone contains two unique features for embodiments of the method. The vector backbone uses a p15A origin of replication, which lowers the copy number of the plasmid, thus reducing the toxicity mediated by the Ad5 E1 module. Additionally, the vector contains a mammalian I-SceI expression cassette, which allows for self-excision of the viral genome from the vector backbone upon transfection.

FIGS. 20-21 diagram an embodiment of the methods provided herein developed for human Ad5. The assembling includes combining a destination vector and one or more entry vectors, each containing an adenoviral gene module, with one or more of either lambda phage integrase, lambda phage excisionase, or the bacterial host integration factor, thereby forming an adenoviral gene module vector. In some embodiments, the entry vectors are formed by adding a recombination site to an adenoviral gene module, followed by combination with a donor vector and one or more of either lambda phage integrase, lambda phage excisionase, or the bacterial host integration factor thereby forming an adenoviral gene module entry vectors.

A destination vector is a nucleic acid to which the adenoviral gene module is to be joined, such as a plasmid. The joining may be by exchange of one or more entry vectors containing the adenoviral gene module to be included (e.g. inserted) within the destination vector. The destination vector may have one or more adenoviral gene modules present prior to contacting (e.g. combining) the recombination competent destination vector and the one or more of the adenoviral gene modules with the integrase (e.g. integrase, excisionase, and/or host integration factor).

Figure 10A:
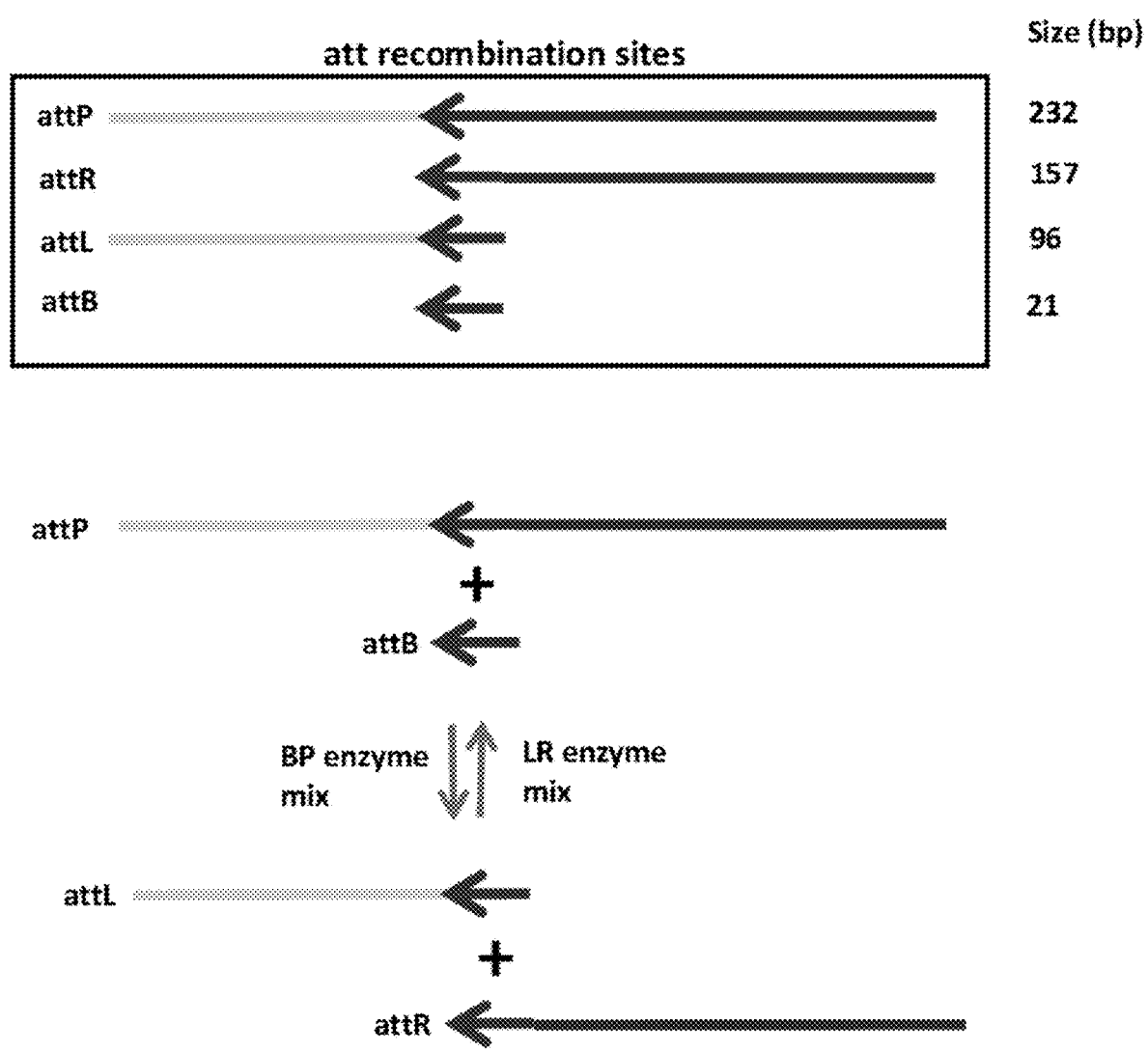
FIG. 10A. A diagram detailing nomenclature and organization of gateway att recombination sites. There are four different att recombination sites that result from Gateway cloning. All four contain a central attB region of 21 bp, which is where the actual recombination takes place. attP sites recombine with attB sites with a specific enzyme mix (BP). The resultant reaction creates attL and attR sites. This reaction is reversible with another enzyme mix (LR), where attL and attR recombine to form attP and attB.
Figure 10B:
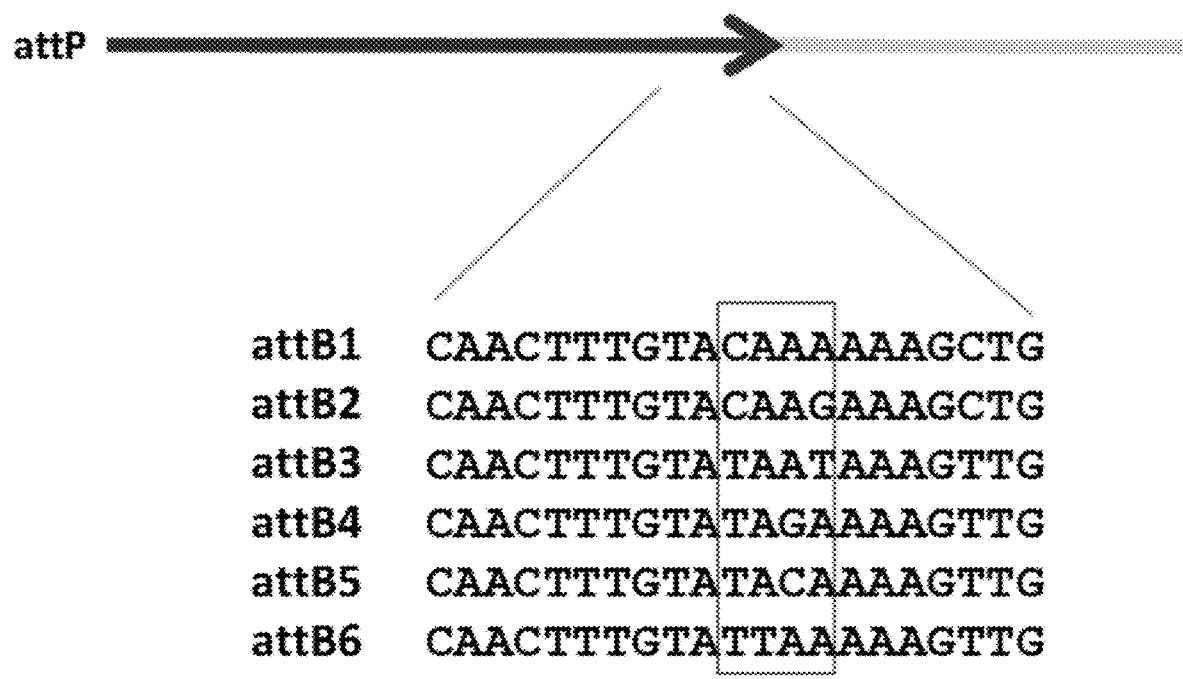
FIG. 10B. Sequence differences between the 6 different att sites (top to bottom, SEQ ID NOs: 158-163). Each site specifically recombines with its match. attB1 sites will only recombine with attP1 sites, attB2 only with attP2, etc.
Figure 11A:
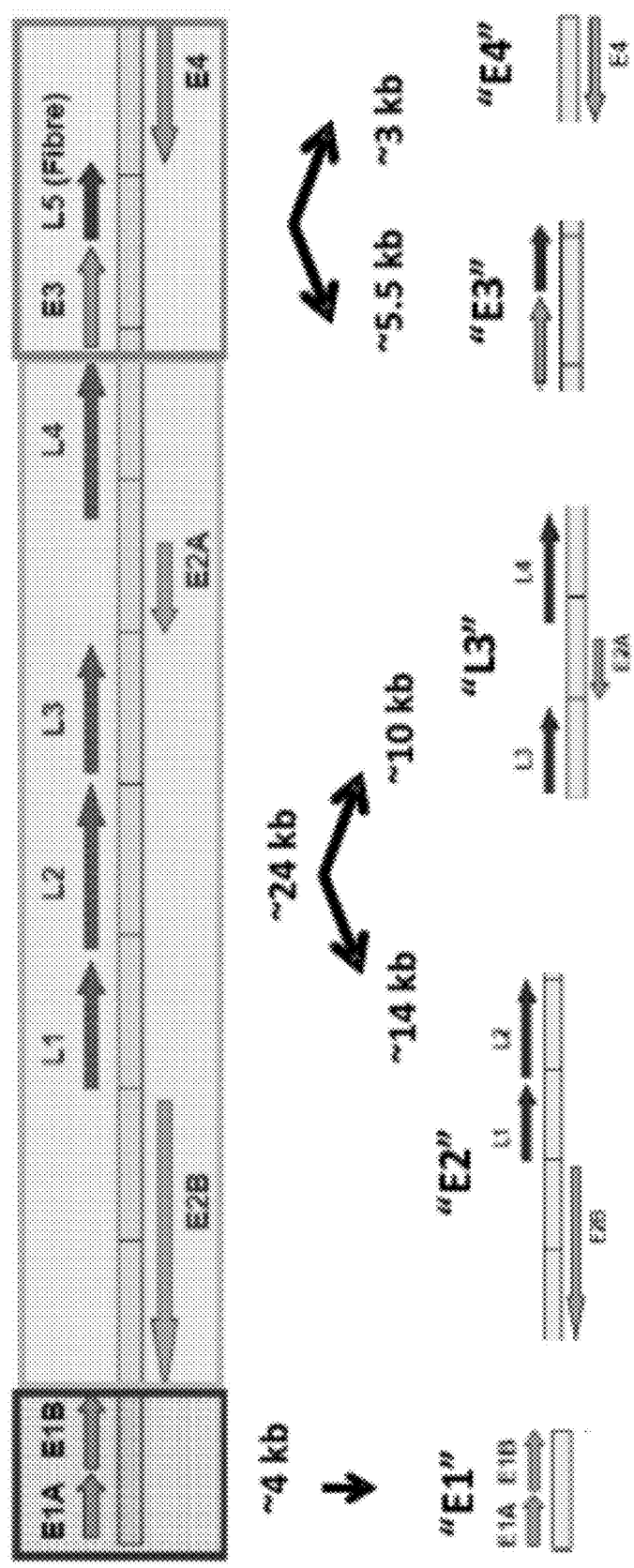
FIGS. 11A-11B. An example of the division of human Ad5 genome (SEQ ID NO: 137) into modules for reassembly (FIG. 11A). Locations of attB site insertions after reassembly of the proposed modules using multisite gateway technology (FIG. 11B).
Figure 11B:
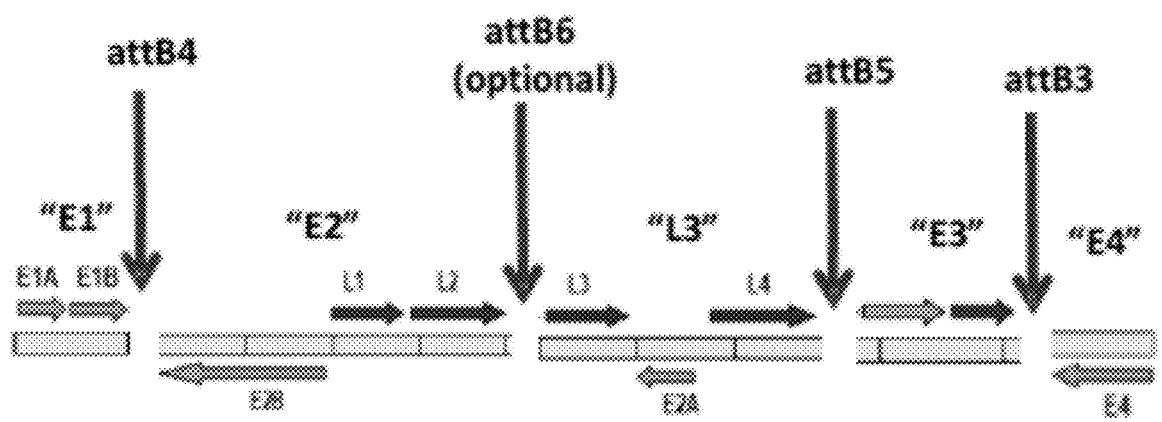
Figure 12A:
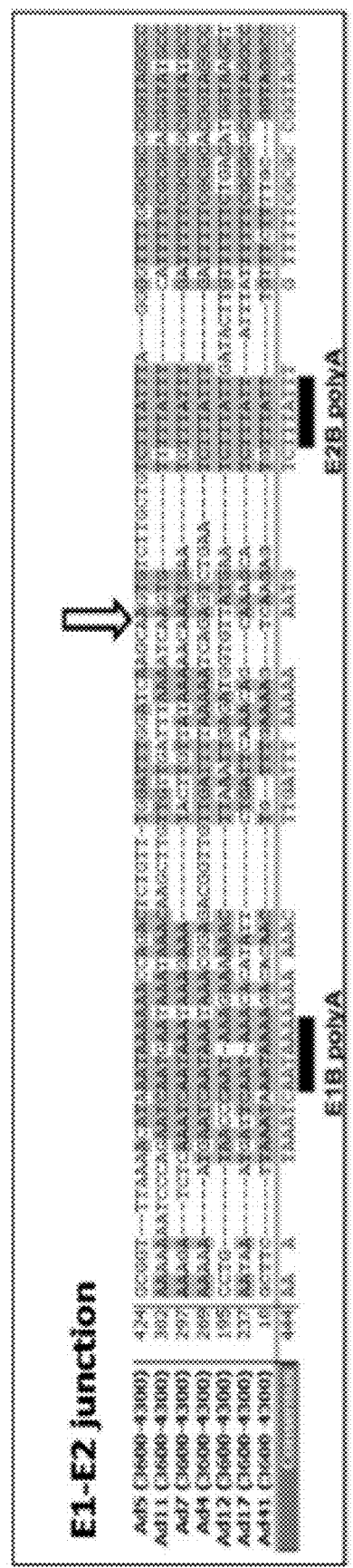
FIGS. 12A-12D. Examples of potential attB insertion sites within the human Ad5 genome (SEQ ID NO: 137). Insertion sites can be determined by alignment of various adenovirus sequences within the targeted region and choosing places around non-conserved sequences. Arrows indicate chosen sites for Ad5.
Figure 12B:
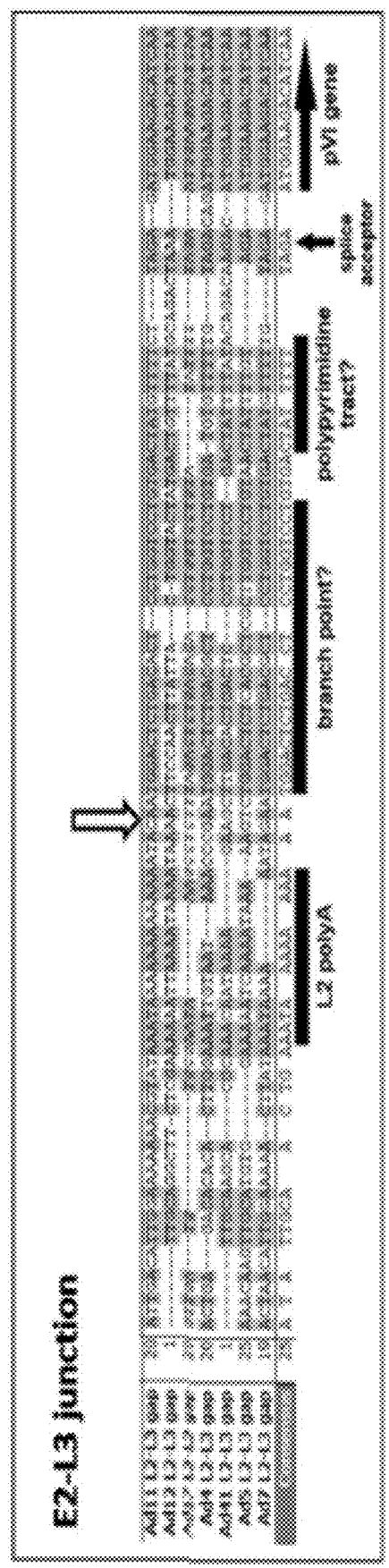
Figure 12C:
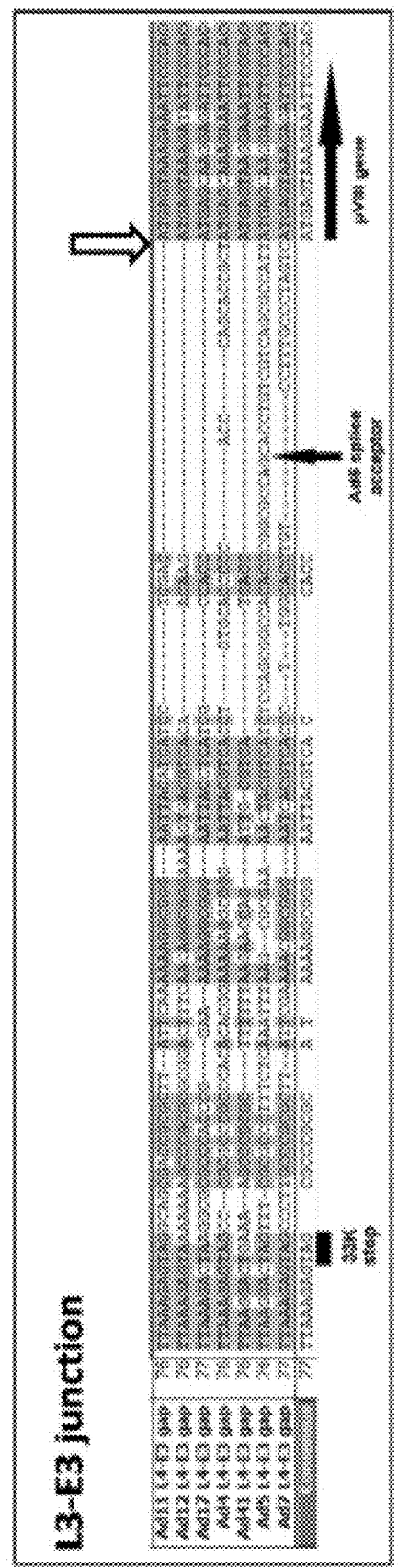
Figure 12D:
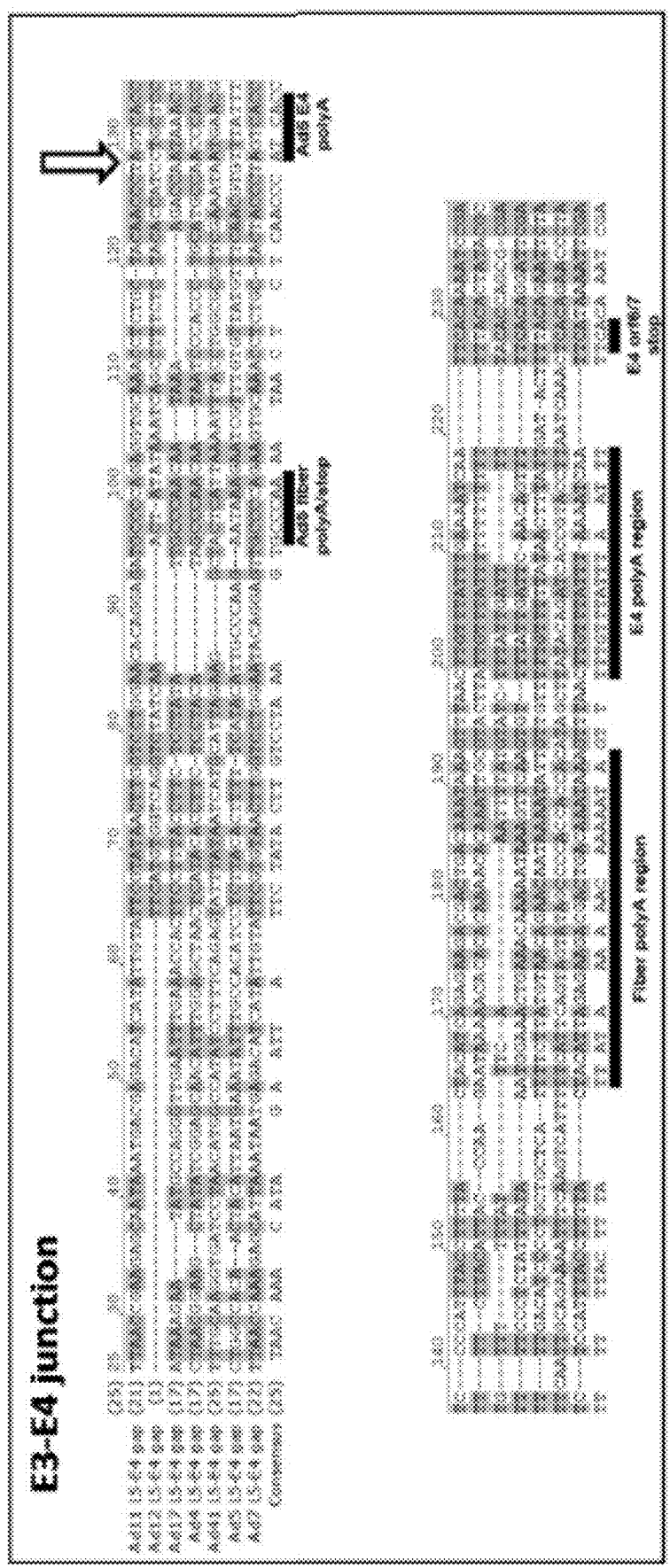

A recombination site nucleic acid sequence, also referred to herein as "att" site, is a nucleic acid sequence that facilitates in vitro site specific recombination between two nucleic acids. In some embodiments, the recombination site nucleic acid sequence is approximately 21 bp in length. For example, a recombination site nucleic acid sequence may be a gateway recombinatorial signal, such as those shown in FIG. 10 and/or set forth in Sone et. al., *J Biotechnol.* (2008) September 10; 136(3-4):113-21; Hartley, et al., *Genome Res.* (2000), 10, 1788-1795; and Sasaki, et al., *J. Biotechnol.* (2004), 107, 233-243. (e.g. attB sites, attL sites, attR sites, attP sites, attBr sites, attPr sites and the like).

In some embodiments, the one or more recombination competent adenoviral gene modules form part of (or are present within) a donor vector. The donor vector may be a plasmid compatible with gateway technology or similar type cloning technology.

In some embodiments, the DEST vectors contain different counterselection cassettes. A counterselection cassette is any DNA fragment that in certain conditions prevents growth of bacterial cells. FIG. 22 describes the efficiencies of various counterselection cassettes that have been used in the methods provided herein.

Figure 19:
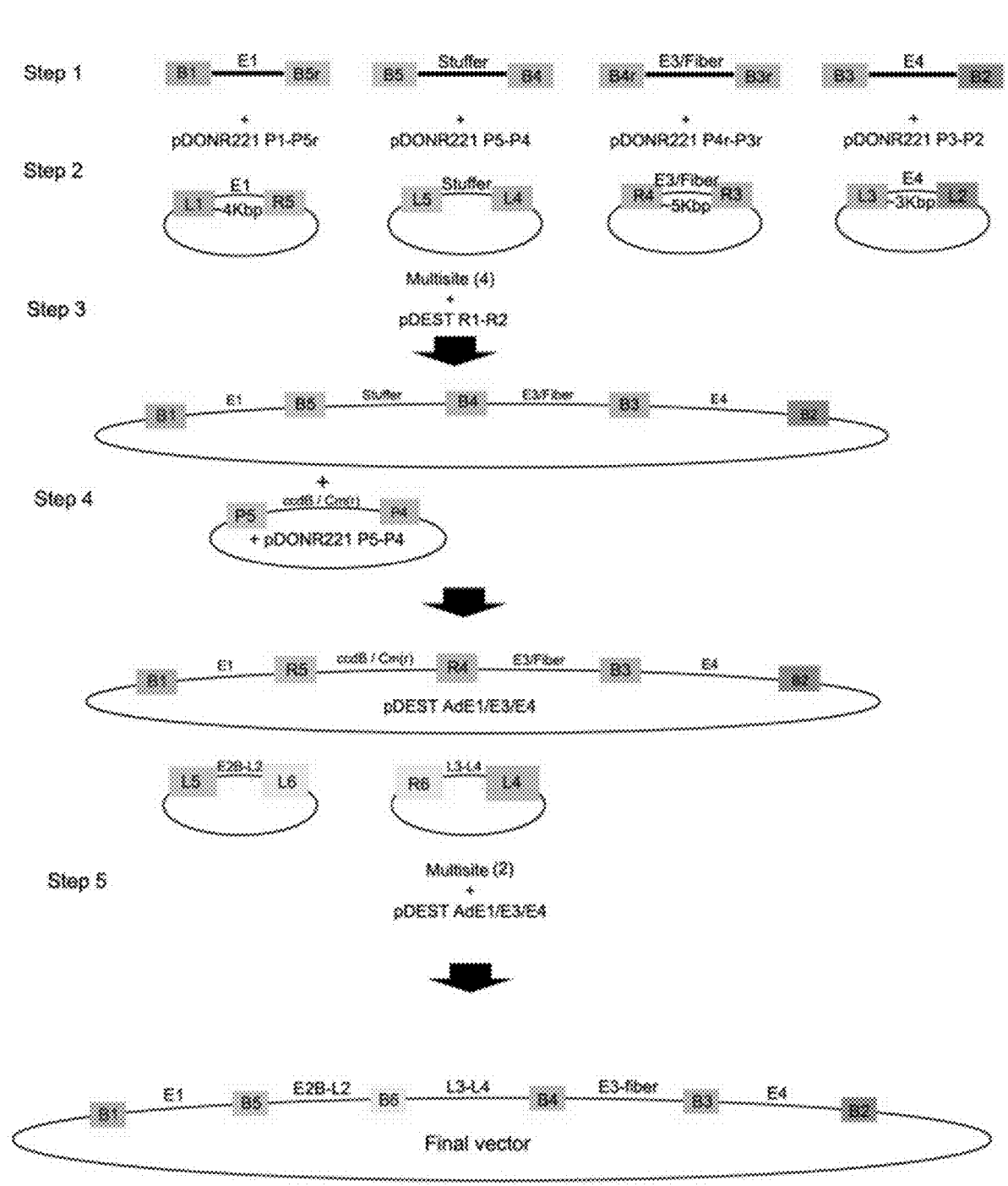
FIG. 19. Initial multisite gateway strategy for reassembly of Ad5 genomes from the five module entry vectors. First, 3 of the 5 entry vectors were combined along with a stuffer vector. The stuffer was then removed to insert a counterselection cassette. The final 2 entry vectors were then combined to create the complete genome. This particular strategy showed toxicity associated with the E1 module and the large size of the E2 and L3 modules.

FIG. 19 details an original proposal for the reassembly of Ad5 adenovirus gene modules using multisite gateway strategies. This particular strategy involves combining four entry vectors, three of which were adenoviral gene modules and a fourth unrelated stuffer module. Once these four modules were combined, the stuffer module is removed by a gateway reaction to create a new destination vector. Lastly, the remaining two adenoviral gene modules are inserted by gateway reaction to complete the viral genome. This original proposal was inefficient when using the larger adenoviral gene modules in gateway reactions, along with the problem of toxicity from the Ad5 E1 module. Combination methods (e.g. SLIC and an SSR method) provided for easier assembly of genomes from the modules (e.g. less steps to perform and greater efficiency for each step).

Figure 16:
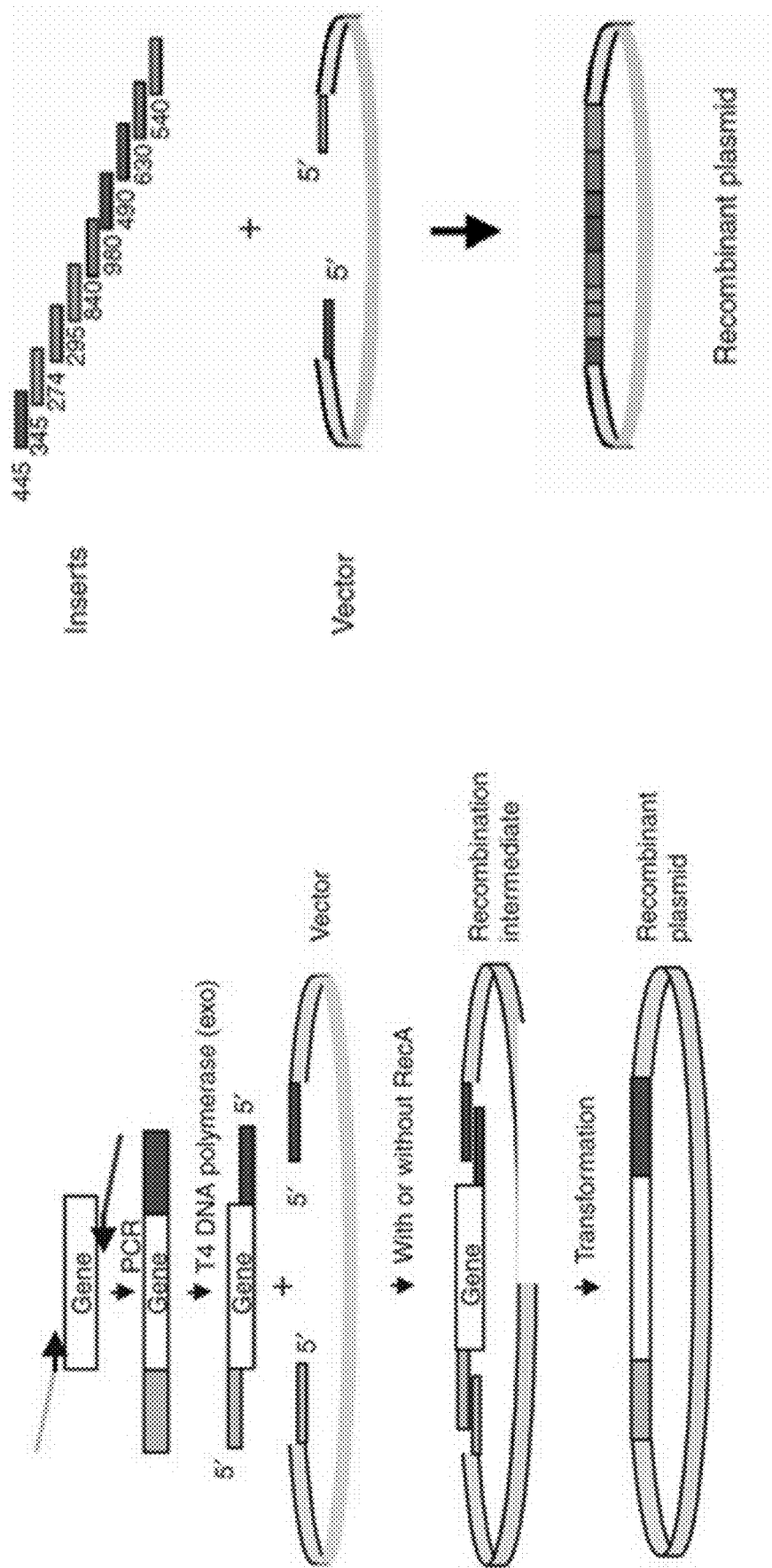
FIG. 16. Diagrams for sequence and ligation independent cloning (SLIC). The left is for single-fragment SLIC, while the right is an example of multi (9) fragment SLIC.
Figure 25:
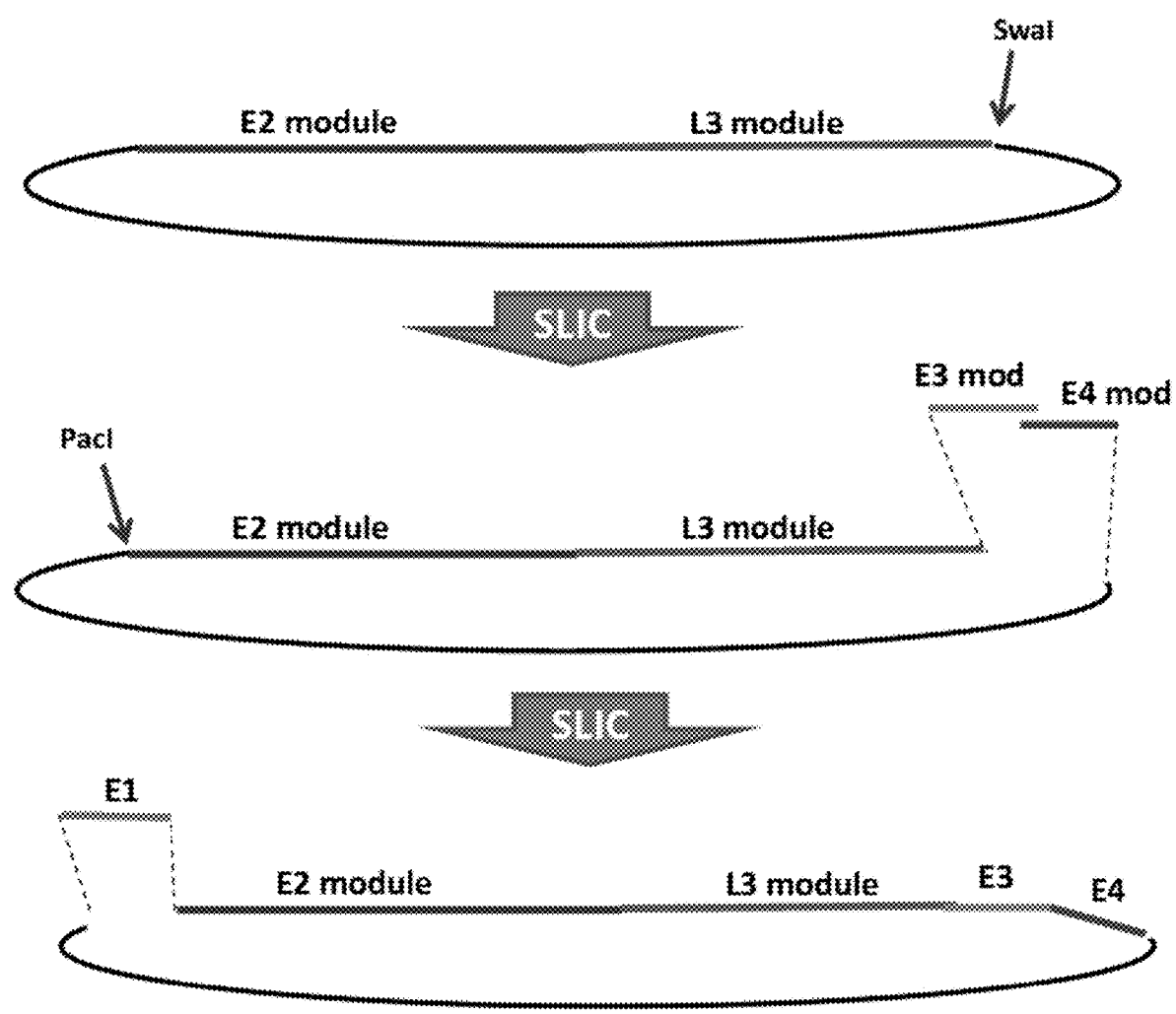
FIG. 25. The method of AdSlicR for human Ad5. Beginning with the E2-L3 core module created for Adsembly, the vector is linearized by SwaI digestion. The E3 and E4 modules are then inserted into the vector using SLIC. The subsequent vector is linearized with PacI, followed by insertion of the E1 module by SLIC, creating a complete genome.

The SLIC technology employs annealing of a single stranded homologous sequence by relying on exonuclease-generated single stranded nucleic acid (e.g. DNA) overhangs in two nucleic acid (e.g. DNA fragments) (FIG. 16). Thus, the SLIC technology employs homologous recombination and single stranded annealing (e.g. hybridization) by relying on exonuclease-generated single stranded nucleic acid (e.g. DNA) overhangs in the inserted nucleic acid (e.g. DNA) and destination vector. Provided herein are methods adapting the SLIC technology for insertion of adenoviral gene modules into a destination vector to form the nucleic acid (e.g. a nucleic acid plasmid). This process may also be referred to herein as AdSlic or AdSlicR. General methods of using SLIC technology is described, for example, in Li et al., *Nature Methods* (2007), 4, 251-256. FIG. 25 diagrams an example of AdSlicR as established for human Ad5. FIG. 26 details the efficiencies of the reactions in the AdSlicR method.

For example, where the SLIC technology (or similar cloning technology) is used, the assembling includes hybridizing (e.g. annealing) a hybridization competent destination vector (e.g. a destination vector (e.g. linear vector)) having a single stranded nucleic acid (e.g. DNA) overhang (e.g. on each terminus)) to one or more of the adenoviral gene modules thereby forming an adenoviral gene module vector. The hybridization competent destination vector may also be referred to herein as a SLIC competent vector. The one or more of the adenoviral gene modules may be a hybridization competent adenoviral gene module (e.g. an adenoviral gene module (e.g. a linear adenoviral gene module)) having at least one single stranded nucleic acid (e.g. DNA) overhang (e.g. on each terminus) sufficiently complementary to the single stranded nucleic acid (e.g. DNA) overhang of the destination vector to facilitate hybridization (e.g. under stringent conditions)). In some embodiments, the destination vector overhang and the adenoviral gene module overhang are each about 20 to 25 bp in length. The hybridization competent destination vector may be formed using any appropriate methodology.

For example, in some embodiments, where the destination vector is circular (e.g. a plasmid), the destination vector is cleaved (e.g. with an endonuclease) thereby forming a linear destination vector. The linear destination vector may then be contacted with an exonuclease (i.e. an enzyme with exonuclease activity such as a T4 DNA polymerase) thereby forming the hybridization competent destination vector. Similarly, the hybridization competent adenoviral gene module may be formed by contacting (e.g. treating) the adenoviral gene module with an exonuclease thereby forming a hybridization competent adenoviral gene module. In some embodiments, hybridizing a hybridization competent destination vector to one or more of the adenoviral gene modules may include combining the hybridization competent destination vector and the adenoviral gene module(s) with a DNA polymerase. In some embodiments, where the adenoviral gene module is circular or contained within a circular plasmid, the adenoviral gene module is linearized by endonuclease treatment prior to exonuclease treatment. Thus, in some embodiments, one or more of the hybridization competent adenoviral gene modules are formed by contacting an entry vector that includes one or more entry vector adenoviral gene modules with an endonuclease, thereby forming one or more released entry vector adenoviral gene modules. The one or more released entry vector adenoviral gene modules may be contacted with an exonuclease, thereby forming one or more hybridization competent adenoviral gene modules. An entry vector adenoviral gene module as referred to herein is an adenoviral gene module that is part of an entry vector. A released entry vector adenoviral gene module as referred to herein is an adenoviral gene module that has been released from an entry vector by for instance a restriction enzyme. In some embodiments, the adenoviral gene module is not circular (e.g. obtained by PCR or gene synthesis) and does not require linearization prior to exonuclease treatment. In some embodiments, annealing a SLIC competent vector to one or more of the adenoviral gene modules may include combining the SLIC competent vector and the adenoviral gene module(s) with a DNA polymerase.

In some embodiments, the SLIC competent vector contains one or more adenoviral gene modules prior to annealing with SLIC competent adenoviral gene modules. Thus, in some embodiments, multiple SLIC reactions are performed sequentially to insert multiple adenoviral gene modules.

Figure 30A:
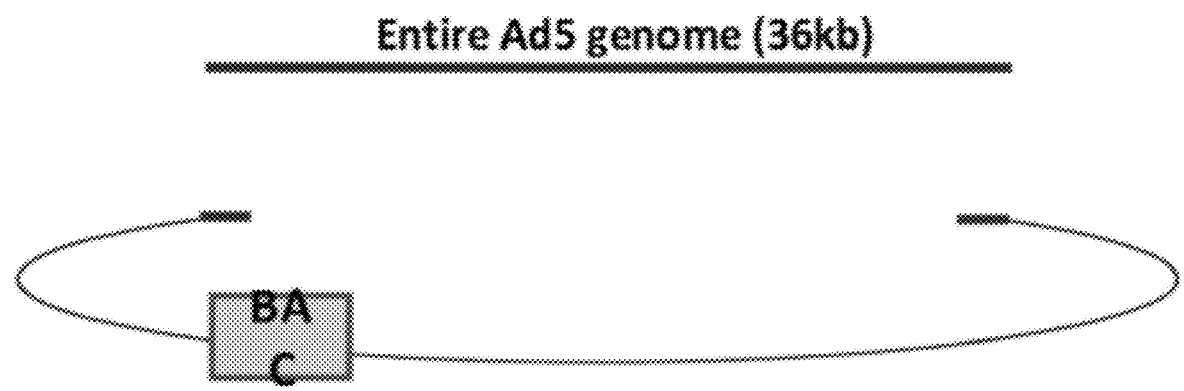
FIGS. 30A-30B. Insertion of entire genomes into plasmids using SLIC.
Figure 30B:
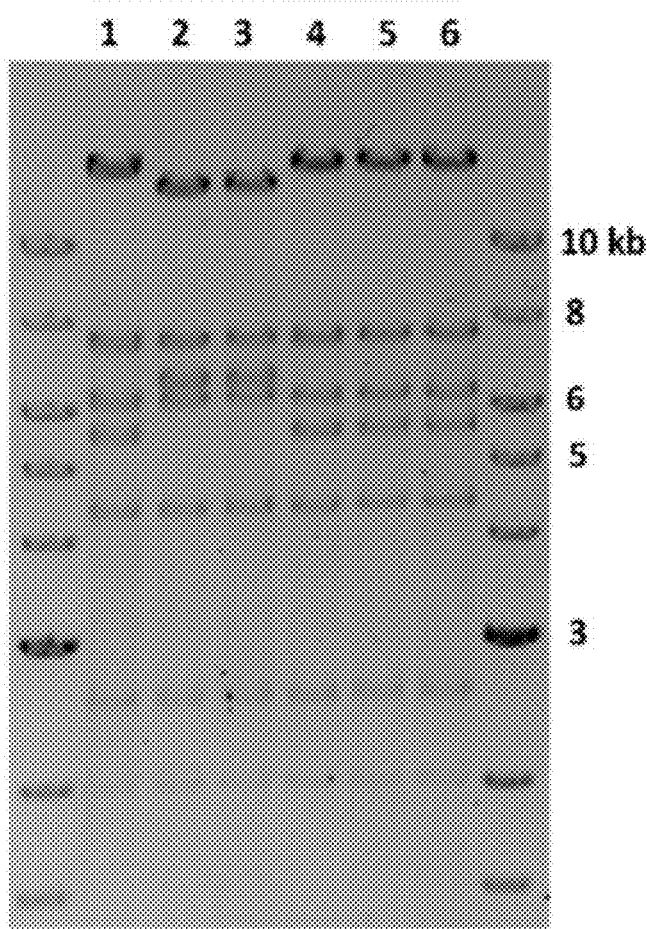

In some embodiments, in order to obtain adenoviral genomes in plasmids to be used as template to generate adenoviral gene modules, SLIC may be used to insert whole adenoviral genomes into a plasmid backbone. In some embodiments, the SLIC competent adenoviral genomes are obtained from purified virus stocks. FIG. 30 diagrams an embodiment of such a process and provides an example for human Ad5.

The adenoviral gene module vector is a nucleic acid having at least one adenoviral gene module. Using the appropriate cloning technology, the desired number of adenoviral gene modules are added to the destination vector to form the adenoviral gene module vector. For example, once formed, the adenoviral gene module (e.g. the adenoviral gene module vector) may be further modified using the appropriate cloning technology (e.g. gateway cloning technology and/or SLIC cloning technology) to add further adenoviral gene modules thereby forming the nucleic acid, which can be expressed (e.g. in cells) to form an adenovirus (e.g. a replicable adenovirus). Thus, in some embodiments, a first adenoviral gene module may be further modified using the appropriate cloning techniques to form second, third and/or forth adenoviral modules in which second third and/or fourth adenoviral gene modules, respectively, are added to the vector thereby forming the nucleic acid, which can be expressed to form an adenovirus (e.g. a replicable adenovirus). Thus, in some embodiments, the nucleic acid is an adenoviral gene module vector.

Indeed, different cloning technologies may be used to assemble the nucleic acid or adenoviral gene module vector. In some embodiments, the assembling includes hybridizing (e.g. annealing) a hybridization competent destination vector to a first adenoviral gene module thereby forming a first adenoviral gene module vector. The first adenoviral gene module may be a hybridization competent adenoviral gene module. The first adenoviral gene module vector and a second adenoviral gene module entry vector may be contacted (e.g. combined) with an integrase (e.g. an integrase, excisionase, or integration host factor) thereby forming a second adenoviral gene module vector. The second adenoviral gene module vector may be a recombination competent second adenoviral gene module vector (e.g. destination vector), and the second adenoviral gene module may be a recombination competent second adenoviral gene module. In some embodiments, the first adenoviral gene module is the E2-L2 module, the L3-L4 module, or the E2-L4 macromodule. The second adenoviral gene module may be the E1 module, the E3 module, or the E4 module. An example of combining cloning methods to assemble the adenoviral gene modules is provided in FIGS. 20-21 which combines SLIC with gateway.

In other embodiments, the assembling includes contacting (e.g. combining) a recombination competent destination vector and a first adenoviral gene module with (e.g. in the presence of) an integrase (e.g. an integrase, excisionase, or integration host factor) thereby forming a first adenoviral gene module vector. The first adenoviral gene module is a recombination competent first adenoviral gene module (e.g.

entry vector). The first adenoviral gene module vector is hybridized to a second adenoviral gene module thereby forming a second adenoviral gene module vector. The first adenoviral gene module vector is a hybridization competent adenoviral gene module vector (e.g. a destination vector). The second adenoviral gene module is a hybridization competent adenoviral gene module (e.g. an entry vector). In some embodiments, the second adenoviral gene module is the E2-L2 module, the L3-L4 module, or the E2-L4 macromodule. The first adenoviral gene module may be the E1 module, the E3 module, or the E4 module.

In some embodiments (e.g. the example of human Ad5), the E2-L2 module and the L3-L4 module are approximately 14 kb and 10 kb, respectively. One of the discoveries provided herein is that the size of the E2-L2 and L3-L4 modules are, in some embodiments, too large to efficiently assemble into the nucleic acid using standard or gateway (e.g. multisite gateway) cloning technologies. An example is provided in FIG. 15. Thus, in some embodiments, SLIC cloning technology (or similar cloning technology) is used to insert these modules into a destination vector (e.g. an entry vector). The other adenoviral gene modules may be added using, for example, gateway cloning technologies. Thus, in some embodiments, where the E2-L2 module and the L3-L4 module assembled into the nucleic acid, it is preferable to assemble the nucleic acid using a combined SLIC and gateway (e.g. multisite gateway) cloning strategy. A particular embodiment of the combined SLIC and gateway (e.g. multisite gateway) cloning strategy is set forth in FIGS. 20-21.

Certain embodiments of the methods provided herein provide fast and efficient adenovirus genome construct assembly. In some instances, the adenovirus genome construct is assembled in less than 10, 9, 8, 7, 6, 5, 4, 3, 2, or 1 hour(s). The methods provided herein further enable the insertion of adenovirus fragments into vectors, facile and independent mutagenesis within individual vectors, and/or multisite specific in vitro assembly.

In some embodiments, one or all of the adenoviral gene modules may be selected from a library of recombinant adenoviral gene modules, as set forth below. Thus, certain embodiments of the Adsembly process enables quick and efficient construction of a wide variety of recombinant adenoviruses there by allowing fast optimization of customized adenoviral functionality based on optimal combinations of adenoviral gene modules. The methods thereby provide the ability to create novel Adenoviral serotype chimeras by mixing and matching parts from various Adenovirus serotypes. This allows for not only combinations imparting the unique properties of each serotype, but the utilization of various tropisms of the serotypes, and their use to potentially avoid pre-existing immunity to prevalent serotypes.

Certain embodiments of the methods provided herein avoid reliance on the limited restriction enzyme site cloning technology. The methods may also enable avoidance of exclusive reliance on Adenovirus serotype 5. Indeed, in the example of human Ad5, where all five of the E1 module, the E2-L2 module, the L3-L4 module, the E3 module, and the E4 module are employed, mutant options are substantially increased over previously known methods. In certain embodiments, the methods provided herein enable the creation of compound changes in the genome simultaneously.

The methods may also enable avoidance of previously known genome assembly relying exclusively on inefficient homologous recombination in specialized bacterial strains or in mammalian cell culture (e.g. MAGIC), which can often take several months. Moreover, certain embodiments of the methods provided herein provide simple protocols with commonly available reagents without the use of specialized bacteria (e.g. ccdB-resistant).

Utilities of the methods and libraries provided herein include, for example:

(1) Mutagenesis of adenoviral genes for gene function analysis.
(2) Adenoviral mutants in which the loss of adenoviral gene functions renders them unable to replicate in normal cells but undergo selective lytic replication in tumor cells in which their functions are complemented.
(3) Targeted gene expression, either as a replication defective vector or replication competent virus.
(4) The methods may provide novel replication defective Adenoviruses for gene expression. The Adenoviruses assembled using the methods herein may be optimized for this purpose. In the case of human Ad5, the library of E1 modules may include for example several E1A or E1B-deleted modules and/or each contain a different mammalian promoter thereby allowing the user to choose the best promoter to express the gene of interest.
(5) Multigene expression utilizing the existing transcriptional architecture of the adenovirus genome.

In some embodiments where each of the E1 module, the E2-L2 module, the L3-L4 module, the E3 module, and the E4 module are employed, the mutations are not present only in the E4 module.

Figure 14:
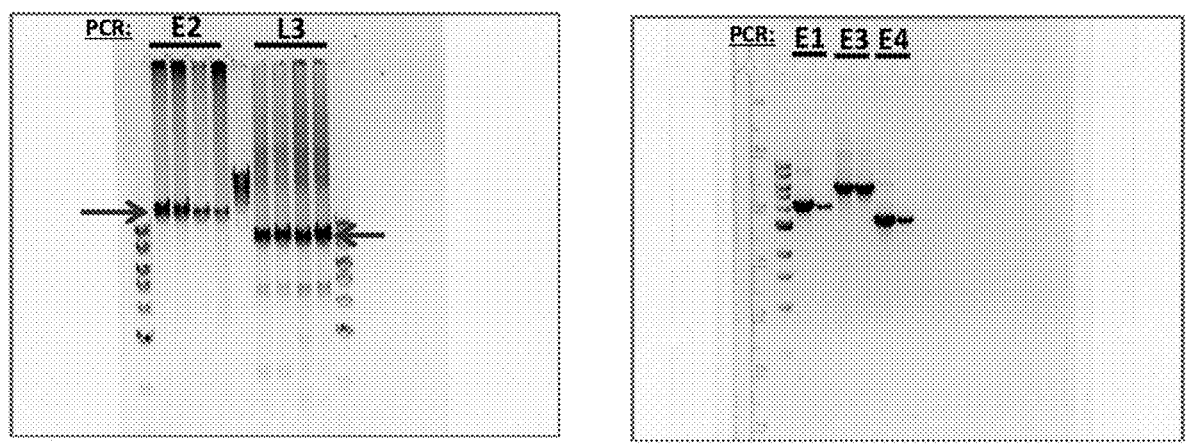
FIG. 14. The Ad5 adenoviral gene modules can be obtained by PCR from DNA obtained directly from purified virus. Ad5 genomic DNA was isolated directly from purified virus and used as template for the Ad5 module PCRs. All five PCRs were successful. Left panel: E2 and L3 module PCRs in quadruplicate. Right panel: E1, E3, and E4 module PCRs in duplicate. Red arrows indicate the desired PCR products. Arrows are omitted on the right since the desired products are so clear.

The E1 module, the E2-L2 module, the L3-L4 module, the E3 module, the E4 module and macromodules thereof may be derived from any appropriate adenovirus using any appropriate methods (e.g. PCR techniques or gene synthesis). For example, PCR from viral genomic DNA obtained from purified virus (FIG. 14) may be employed. FIG. 13 details PCR efficiencies obtained for the human Ad5 adenoviral gene modules. In some embodiments, the combination of the E1 module, the E2-L2 module, the L3-L4 module, the E3 module, and the E4 module constitute or macromodules thereof constitute a complete, or substantially complete adenoviral genome. Using the teachings provided herein, a person having ordinary skill in the art may determine the precise locations of the breaks between the modules. For example, a bioinformatics approach may be used to determine optimal insertion sites for recombination site nucleic acid sequences (e.g. a gateway recombinatorial signal or a gateway recombination site). Several Adenovirus serotypes may be aligned, and the genomic regions between adenoviral gene modules may be analyzed for conservation. In some embodiments, nucleotide conservation between serotypes are avoided, whereas degenerate regions are acceptable insertion sites. For example, certain appropriate positions of insertion sites for recombination site nucleic acid sequences in human Ad5 are denoted with arrows in FIG. 12, FIG. 35, FIG. 36, FIG. 37 and FIG. 38.

In some embodiments, the sequence between adenoviral gene modules may be short thereby necessitating duplication of sequences. An example is provided in FIG. 12, where, due to the short amount of sequence between the Ad5 fiber polyA and the E4 polyA, a duplication of 27 bp of Ad5 sequence was inserted along with the attB site insertion.

In some embodiments, the nucleic acid (e.g. adenoviral gene module vector) includes one or more recombination site nucleic acid sequences. FIGS. 35-39 disclose examples, which are by no means intended to be limiting, of how the nucleic acid sequence position of the recombination site nucleic acid sequence within a recombinant adenovirus effects the growth rate of the recombinant adenovirus. Thus, in some embodiments, a recombinant adenovirus including one or more recombination site nucleic acid sequences (e.g. att sites) may grow slower than a recombinant adenovirus lacking one or more recombination site nucleic acid sequences. In other embodiments, a recombinant adenovirus including one or more recombination site nucleic acid sequences (e.g. att sites) may grow at least as fast as a recombinant adenovirus lacking one or more recombination site nucleic acid sequences. In other embodiments, the nucleic acid (e.g. adenoviral gene module vector) includes a recombination site nucleic acid sequence between the E3 module and the E4 module. In some embodiments, the recombination site nucleic acid sequence between the E3 module and the E4 module is an attB3 recombination site nucleic acid sequence. In some embodiments, the nucleic acid (e.g. adenoviral gene module vector) includes a recombination site nucleic acid sequence following nucleotide 32904 as set forth in SEQ ID NO: 137 or an equivalent nucleotide in a homolog thereof. In other embodiments, the nucleic acid (e.g. adenoviral gene module vector) includes a recombination site nucleic acid sequence between the E1 module and the E2-L2 module. In other embodiments, the nucleic acid (e.g. adenoviral gene module vector) includes a recombination site nucleic acid sequence following nucleotide 4035 as set forth in SEQ ID NO: 137 or an equivalent nucleotide in a homolog thereof. In other embodiments, the nucleic acid (e.g. adenoviral gene module vector) includes a recombination site nucleic acid sequence following nucleotide 3608 as set forth in SEQ ID NO: 137 or an equivalent nucleotide in a homolog thereof. In some embodiments, the nucleic acid (e.g. adenoviral gene module vector) includes a recombination site nucleic acid sequence between the L3-L4 module and the E3 module. In some embodiments, the recombination site nucleic acid sequence between the L3-L4 module and the E3 module is an attB5 recombination site nucleic acid sequence. In other embodiments, the nucleic acid (e.g. adenoviral gene module vector) includes a first recombination site nucleic acid sequence between the E1 module and the E2 module, a second recombination site nucleic acid sequence between the L3-L4 module and E3 module and a third recombination site nucleic acid sequence between the E3 module and the E4 module. In other embodiments, the first recombination site nucleic acid sequence is included in the nucleic acid following nucleotide 4035 as set forth in SEQ ID NO: 137 or an equivalent nucleotide in a homolog thereof, and the third recombination site nucleic acid sequence is included in the nucleic acid following nucleotide 32904 as set forth in SEQ ID NO: 137 or an equivalent nucleotide in a homolog thereof.

Listed below is one example of an implemented insertion strategy showing four insertions into the Ad5 genome (SEQ ID NO: 137). The numbers denote the nucleotide position within the published Ad5 genome sequence where the insertion site is located for insertion of the recombination site nucleic acid sequence. In the examples below, the attB sequences (i.e. the recombination site nucleic acid sequences) are underlined, and the duplication in Ad5 sequence for the final insertion is in bold. A person of ordinary skill in the art would immediately recognize appropriate and/or equivalent insertion sites in similar contents or homologous virus sequences.

Between 4075 and 4076:
(SEQ ID NO: 144)
<u>CAACTTTTCTATACAAAGTTGTA</u>

Between 17959 and 17960:
(SEQ ID NO: 145)
<u>CAACTTTTTAATACAAAGTTG</u>

Between 27173 and 27174:
(SEQ ID NO: 146)
<u>TCAACTTTGTATACAAAAGTTGTG</u>

Between 32815 and 32816:
(SEQ ID NO: 147)
<u>ACAACTTTGTATAATAAAGTTGCT</u>GAATCGTTTGTGTTATGTTTCAACGTG

Figure 24A:
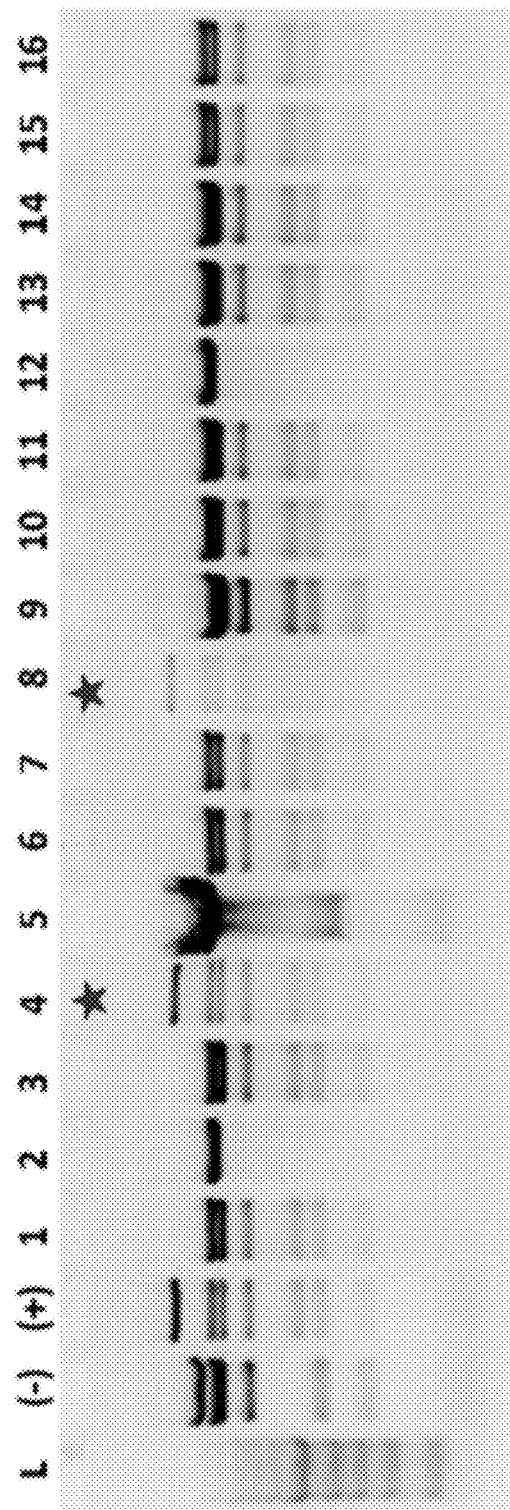
FIGS. 24A-24B. Efficiencies of the Adsembly reaction.
Figure 24B:
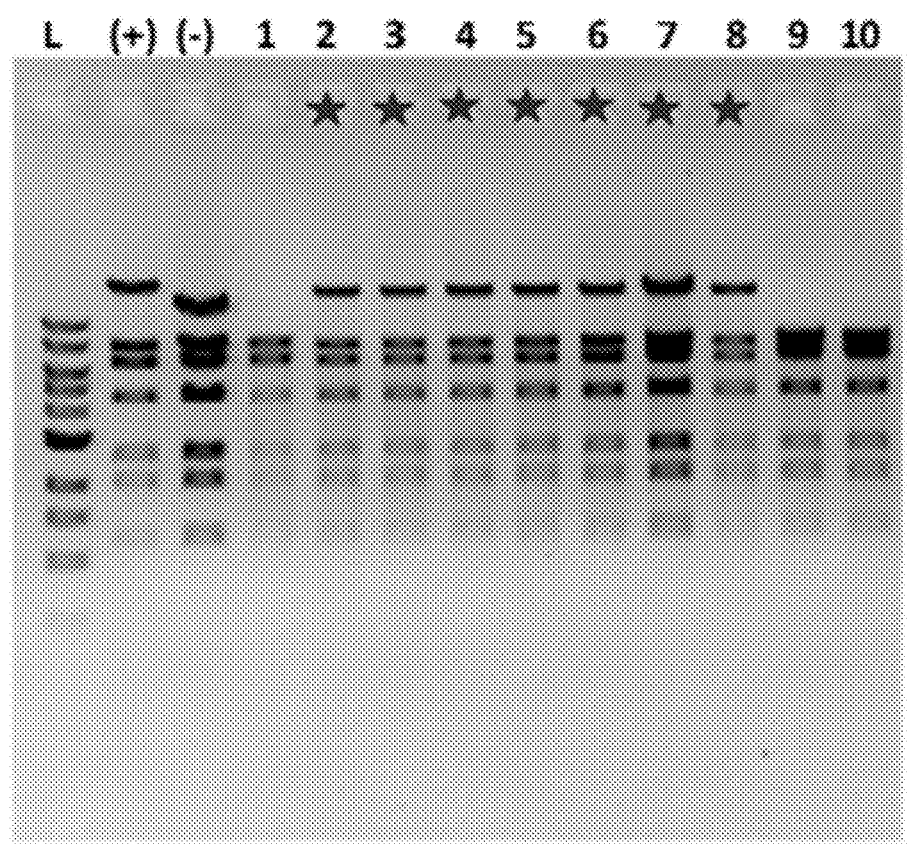
Figure 27A:
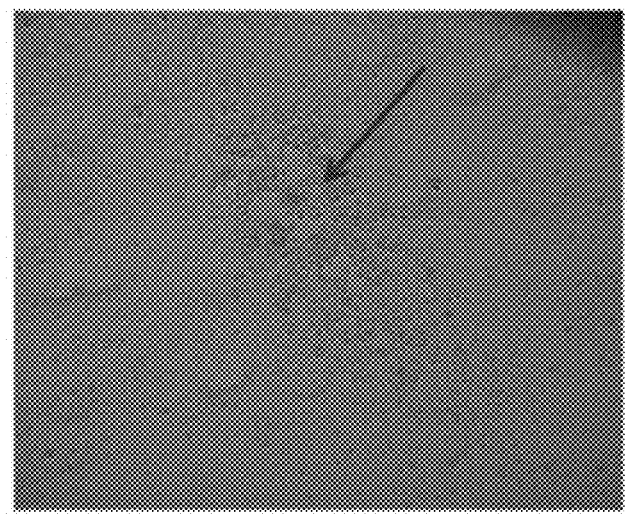
FIGS. 27A-27B. The Adsembled virus grows in tissue culture.
Figure 27B:
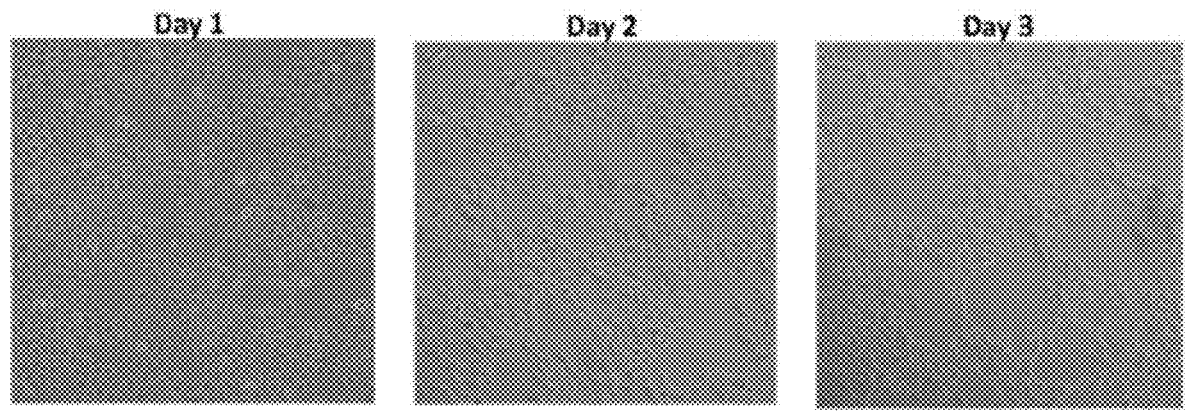
Figure 28:
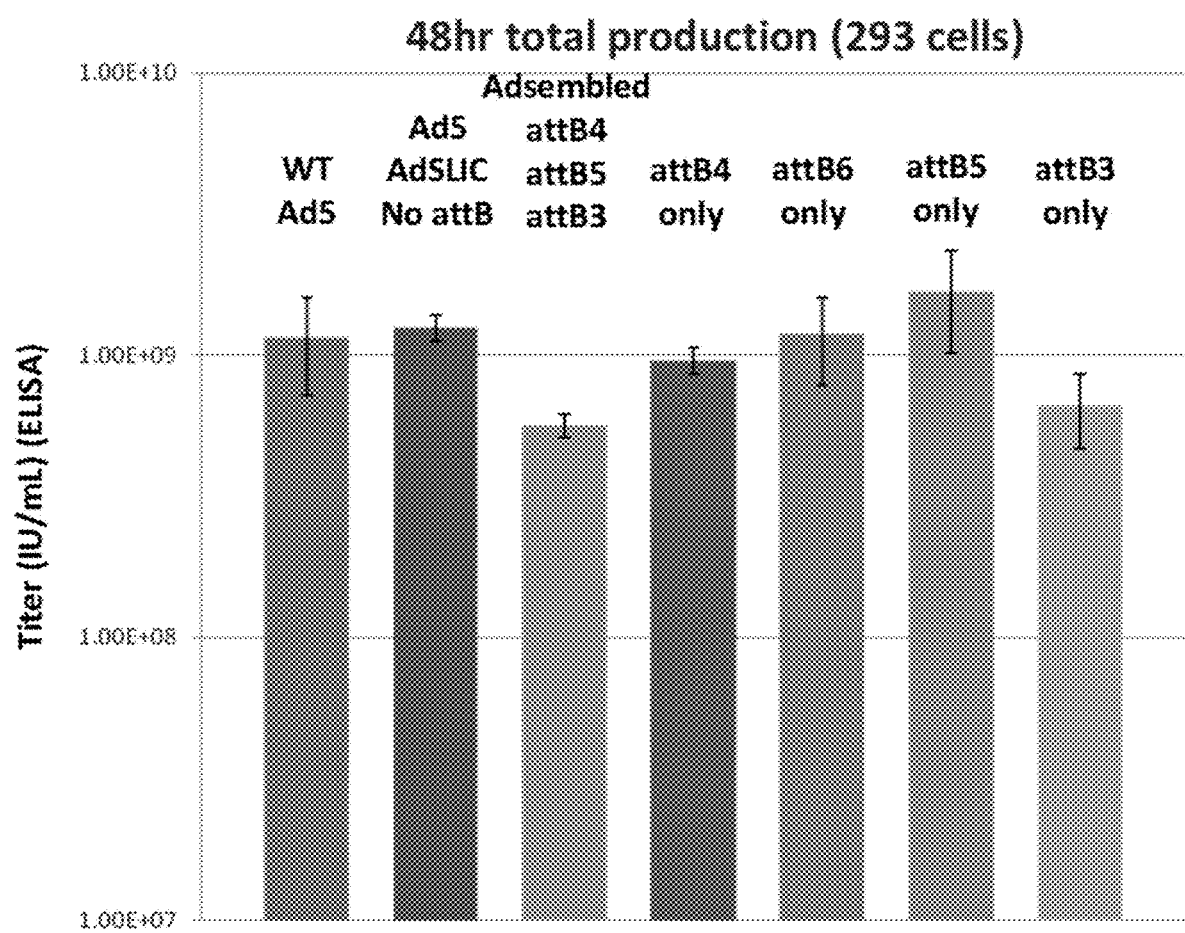
FIG. 28. Adsembled Ad5 has only a slight decrease in titers when grown in 293 cells. 293 cells were infected at an MOI=10 with either wild-type Ad5, Adsembled Ad5, or AdSLIC Ad5 containing either no attB insertions or each of four attB insertions individually. Total virus was collected after 48 hours and titered by ELISA. The only viruses that show any defect are the Adsembled virus and the AdSLIC virus containing only the attB3 insertion. Both show a modest 2-fold decrease compared to wild-type levels. These data also demonstrate that viruses created using AdSLIC have no replication defect in 293 cells. Input levels for all viruses were titered and were near 1e7 IU/mL (not shown).

The assembly strategy in FIG. 21 has been used 17 times to yield infectious human Ad5 virus. FIG. 24 details the efficiencies of the methods provided herein. On four separate occasions, wild-type Adsembled adenovirus has been transfected into cells and virus has been produced. Additionally, this protocol has generated 13 mutant adenoviruses, all of which produce infectious virus. FIG. 27 provides images of reassembled wild-type Ad5 from the transfection as a single plaque and also passaged onto 293 cells. The viruses produced from the strategy in FIGS. 20-21 and FIG. 25 have been tested for replication efficacy in 293 cells, as shown in FIG. 28.

In another aspect, an adenovirus made by a method disclosed herein is provided. In some embodiments, the adenovirus is replication competent. In another embodiment, the adenovirus is not replication competent.

II. Adenoviral Gene Module and Macromodule Libraries

In another aspect, a library including a plurality of adenoviral gene modules (e.g. macromodules) are provided. In some embodiments, the library includes a plurality of different E1 modules. In other embodiments, the library includes a plurality of different E2-L2 modules. In other embodiments, the library includes a plurality of different L3-L4 modules. In other embodiments, the library includes a plurality of different E3 modules. In other embodiments, the library includes a plurality of different E4 modules. In other embodiments, the library includes a plurality of different core macromodules. In some embodiments, the adenoviral genome library is prepared according to a methods described above.

In other embodiments, the library includes a plurality of different E1 modules, a plurality of different E2-L2 modules, a plurality of different L3-L4 modules, a plurality of different E3 modules, a plurality of different E4 modules, and/or a plurality of difference core macromodules. In some embodiments, the library includes a plurality of different macromodules, wherein the macromodules include a plurality of different E1-L2 macromodules, a plurality of different E2-L4 macromodules (i.e. core macromodules) and/or a plurality of different E3-E4 macromodules.

In some embodiments, the plurality of different adenoviral gene modules and/or macromodules are different in that they are derived from different types of adenoviruses (e.g. different species or different serotype). For example, in some embodiments the plurality of different E1 modules, the plurality of different E2-L2 modules, the plurality of different L3-L4 modules, the plurality of different E3 modules, the plurality of different E4 modules, and/or the plurality of different macromodules (e.g. core macromodules) comprise adenoviral gene modules from a plurality of adenoviral types (e.g. more than one human adenoviral serotype).

In some embodiments, the plurality of different adenoviral gene modules and/or macromodules are different in that they encode different mutant modules or macromodules (e.g.

a deleted adenoviral nucleic acid sequence, a substituted adenoviral nucleic acid sequence, an ectopic adenoviral nucleic acid sequence, or a nucleic acid sequence encoding a non-adenoviral gene product). For example, the library may include a plurality of different E1 modules, a plurality of different E2-L2 modules, a plurality of different L3-L4 modules, a plurality of different E3 modules, a plurality of different E4 modules, or a plurality of different of macromodules (e.g. core macromodules) including a deleted adenoviral nucleic acid sequence, a mutated adenoviral nucleic acid sequence, an ectopic adenoviral nucleic acid sequence, or a nucleic acid sequence encoding a non-adenoviral gene product.

In some embodiments, the plurality of different adenoviral gene modules and/or macromodules are recombination competent (e.g. contained within an entry vector). For example, the library may include a plurality of different E1 modules, a plurality of different E2-L2 modules, a plurality of different L3-L4 modules, a plurality of different E3 modules, a plurality of different E4 modules, and/or a plurality of different of E2-L4 macromodules modules that are recombination competent.

In some embodiments, the plurality of different adenoviral gene modules and/or macromodules are hybridization competent (e.g. SLIC competent such as after linearization). For example, in some embodiments, the library includes a plurality of different E1 modules, a plurality of different E2-L2 modules, a plurality of different L3-L4 modules, a plurality of different E3 modules, a plurality of different E4 modules, and/or a plurality of different of E2-L4 macromodules that are hybridization competent.

Portions of the libraries provided herein may be created by different users and shared between different users. The various adenoviral gene modules may be mixed and matched to build novel adenoviral constructs with desired functionality or lack of functionality. The methods and libraries herein, therefore, provide the ability to create novel Adenoviral serotype chimeras by mixing and matching parts from various Adenovirus serotypes. The library of adenoviral gene modules provides users multiple options for building their ideal adenoviral vector.

Figure 18:
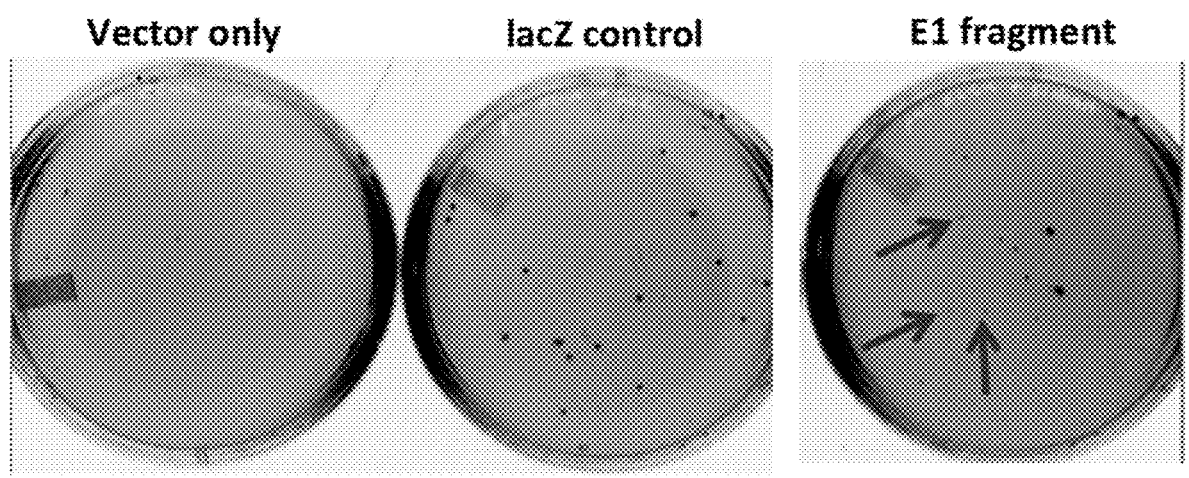
FIG. 18. The Ad5 E1 region is moderately toxic to bacteria. The Ad5 E1 region or a control (lacZ) were inserted into the gateway DONR vectors using SLIC. All the colonies on the lacZ control were "normal" sized, and positive for lacZ insertion. Only two "normal" sized colonies appeared on the E1 plate, and both were negative for E1. However, several smaller colonies were present (arrows), all of which were positive for E1. Thus, the Ad5 E1 region slows the growth of bacteria. This explains why we had problems inserting E1 using gateway recombination reactions.

In some embodiments, an adenoviral gene module may be toxic to bacteria. For example, FIG. 18 demonstrates the toxicity of the human Ad5 E1 module. In some embodiments, an adenoviral gene module may need to be contained within plasmids that are maintained at lower copy number (e.g. p15A origin of replication).

Figure 17:
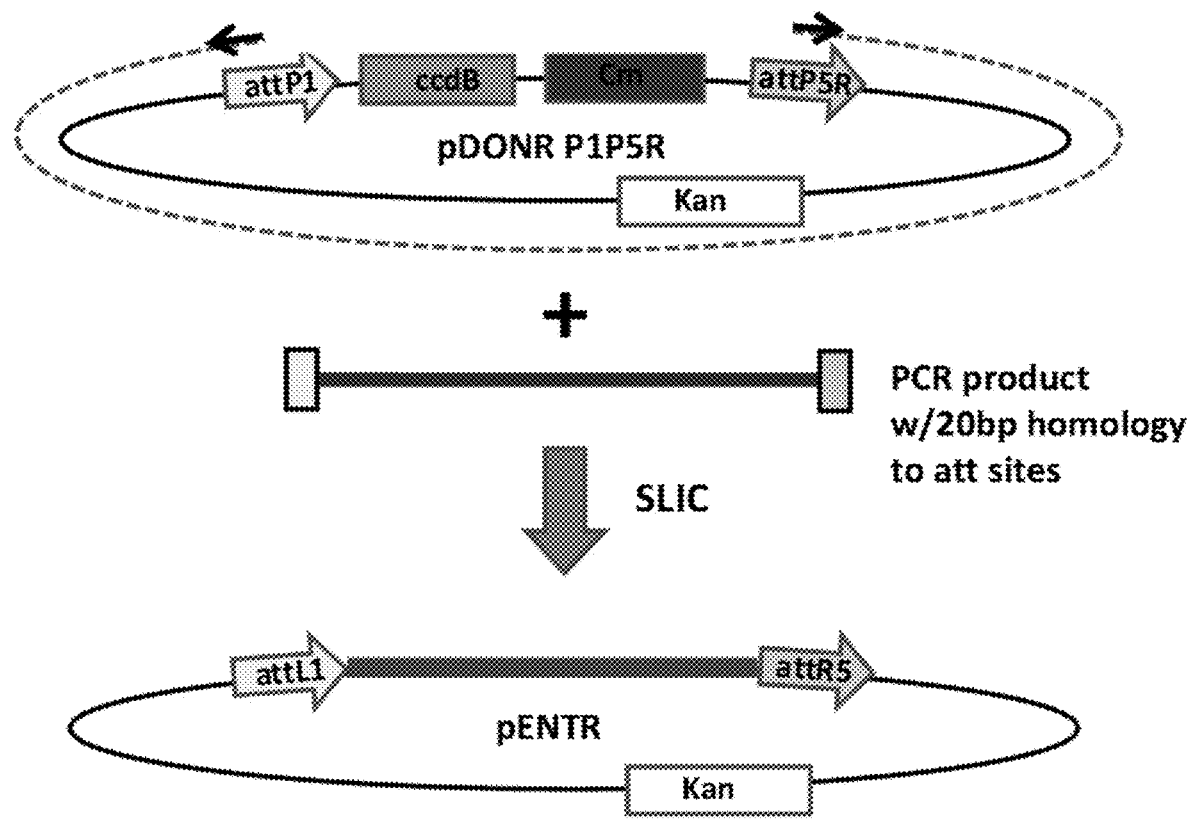
FIG. 17. The use of SLIC to create gateway entry vectors without using gateway cloning enzymes.

In some embodiments, an adenoviral gene module toxicity, size, or other factor may prevent their use in SSR methods (e.g. gateway reactions). For example, FIG. 15 details standard gateway BP reaction efficiencies for the 5 human Ad5 adenoviral gene modules. In some embodiments, an adenoviral gene module that is inefficient using an SSR method (e.g. a gateway reaction) may be manipulated by alternative cloning methods (e.g. SLIC). FIG. 17 diagrams a strategy to use SLIC in place of an SSR method (e.g. using gateway cloning enzymes) to create entry vectors.

III. Kits

In another aspect, a kit is provided for us in the methods and libraries provided herein that include a nucleic acid including two or more adenoviral gene modules selected from an E1 module, an E2-L2 module, an L3-L4 module, an E3 module, an E4 module, or an adenoviral macromodule (or mutant thereof as described below). Appropriate components of the kit include the compositions and components discussed above in Sections I and/or II.

For example, in some embodiments, the kit may include a nucleic acid including three, four or five adenoviral gene modules selected from an E1 module, an E2-L2 module, an L3-L4 module, an E3 module, an E4 module or an adenoviral macromodule. The nucleic acid may form part of a vector (e.g. a plasmid), as discussed above (e.g. a destination vector or donor vector).

In some aspects, the kits provided herein may include a vector with or without an adenoviral gene module. Vectors useful in the kits may include one or more recombination site nucleic acid sequences and/or a single stranded nucleic acid overhang (or a nucleic acid sequence capable of forming a single stranded nucleic acid overhang upon contact with an appropriate enzyme.) In some embodiments, the vector is a hybridization competent destination vector, a SLIC competent vector or a donor vector as described above. The vectors may include one or more adenoviral gene modules. In some embodiments, the vector includes include a counterselection cassettes.

Additional components of kits for practicing the methods provided herein would be readily apparent in view of the present description of the Adsembly methods and Libraries (e.g. exonucleases, integrases, promoter sequences etc.)

IV. Examples

The following examples are offered to illustrate, but not limit the claimed invention.

A. Methods of Viral Assembly

1. 'Combining' Chemistry and 'Recombining' Viral Genomes to Develop Next Generation Viral Vectors and Replicating Lytic Cancer Therapies We developed the use recombination strategies for the rapid de novo assembly of viral genomes from component parts, allowing the systematic combination of multiple modifications and heterologous elements.

The potential of adenoviral vectors in several applications is hindered by the ability to engineer and combine multiple genetic modifications rapidly and systematically. The main methods being used for the most part depend on the availability of unique of suitable restriction enzyme sites at appropriate locations in the genome and are not generally amenable for systematic use or creating precise compound modifications in rapid single step. The manipulation of large genomic DNA fragments and the paucity of unique restriction sites make this technically challenging and limited. Another method requires the generation of a smaller 'shuttle' vector with the genomic region to be modified, and a 'backbone' vector with the viral genome. The major rate limiting step for these vectors is recombination, which either occurs by homologous recombination in mammalian cells (a very low frequency event, occurring at random sites and requiring multiple rounds of plaque purifications to isolate the desired recombinant) or by homologous recombination in special bacterial strains. These methods are limited.

To overcome the limitations of current technologies, we have developed a novel adenovirus genome assembly strategy that enables the rapid and systematic generation of compound viral mutants overnight. This eliminates inefficient and imprecise recombination in mammalian cells, the need for available BACs or shuttle vectors, time-consuming and laborious plaque purifications. This strategy provides the ability to assemble in vitro novel viral genomes rapidly from component parts, including: 1) multiple mutations/modifications to viral genes, 2) genes from other viral subtypes e.g. viral coat proteins that bind different receptors and switch serotypes, 3) ectopic genes e.g. pro-drug converting enzymes to induce potent tumor by-stander effects, 4) the addition of fluorescent reporters or tags for in vivo imaging and diagnostics, and 5) directed in vitro viral evolution. In addition, this technology takes advantage of the natural viral transcriptional architecture, which for human Ad5 encodes 36 genes (not including splice variants), so that multi-protein complexes and entire pathways can be assembled, delivered and co-expressed via adenoviral infection.

To overcome the limitations of Ad2/5 and current methodologies, we have developed Adsembly methods that enable the rapid de novo assembly of adenoviral genomes in vitro from genomic component parts and heterologous elements. Using a bioinformatics approach, we split the different adenoviral genomes (36-38 kb) into 5 units, based on evolutionarily conserved sequences, transcriptional and functional modules. Each of these 5 units comprise compatible sections of a genomic building "parts library", the functions and diversity of which is altered by engineering mutations or heterologous elements and further expanded by adding equivalent units from disparate adenovirus serotypes, mutants and species. In order to create a new adenovirus with unique properties, one of each of the units is selected from the library and rapidly reassembled into a complete genome in vitro using Adsembly (e.g. Ad-SlicR). Adsembly can be used to assemble a novel genome via multi-site specific recombination, which upon transfection, self-excises from a plasmid backbone and replicate to produce novel viruses. Ad-SlicR is a strategy that may be used to erase inserted recombination sequences for more potent viral replication (if necessary) and clinical use. The strategies disclosed herein may use a library genome building blocks, created from human and/or animal adenoviruses that have different tropisms to Ad2/5 and other desirable properties or which have been genetically modified to confer altered functionality.

To achieve this, we exploit a modified X, phage site specific recombination system with improved specificity and efficiency, also known as 'Gateway.' There are 4 classes of recombination sites called attB, attP, attL, and attR, which are recombined by distinct phage enzymes. Recently, novel att site specificities have been identified, that allow simultaneous recombination of multiple DNA fragments in a defined order and orientation. Disclosed herein is a novel application of this system to assemble de novo entire viral genomes from genomic component parts. Surprisingly, this technology revolutionizes the development and potential applications of adenoviral vectors.

Sets of primers incorporating unique pairs of attB sites (numbered 1-6) are used to amplify the viral genome in matched contiguous groups. The Ad5 adenoviral genome is 36 kb and is temporally divided into 'early' (E) and 'late' (L) transcriptions units, which together encode 36-40 genes.

Wild type Ad5/2, mutants of Ad5/2 and disparate adenoviral subtypes or animal viruses are used as DNA templates. PCR fragments are recombined into 'Entry' vectors to generate a library with the constituent elements of the adenoviral genome. LR recombination into a destination vector assemble multiple permutations of individual elements into novel viral genomes (FIG. 1B). This is facilitated by positive selection for the destination vector's antibiotic resistance and the negative selection of unreacted destination vectors in E. coli afforded by the toxic gene, ccdB (Hartley et al., 2000). In case the number or size of fragments limits recombination efficiency, intermediate destination vectors are created where modular replacement or complete assembly occurs in a second BP/LR reaction. This quick and novel method of viral DNA manipulation transforms the engineering of novel viruses by taking advantage of the innate chemistry of DNA recombination.

Additional combinations are integrated, for example, Adenovirus 34 Fiber which binds to the CD46 cellular receptor and evades neutralizing antibodies produced to Ad2/5 viruses.

2. Materials and Methods

Using the above guidelines, modified adenoviruses were made with the below references components. Gateway DONR vectors were employed. In the example of human Ad5, the E1 module was obtained by PCR and inserted into the vector pDONR P1P4 using SLIC. The pDONR P1P4 vector backbone including attL1 and attL4 recombination sites was amplified using PCR and combined with the Ad5 E1 module by SLIC. In order to generate an alternate counterselection cassette, vector pDONR P1P4 was modified. This vector backbone including attP1 and attP4 recombination sites was amplified using PCR and combined with the PheS$^{A294G}$ mutations and a Tetracycline resistance cassette (the pLac-Tet cassette from pENTR L3-pLac-Tet-L2) to create a new DONR vector. The attR1-PheS$^{A294G}$-Tet(r)-attR4 fragment from the new DONR vector was then amplified by PCR and inserted into the Adsembly DEST vector. See "MultiSite Gateway® Pro Plus", Cat#12537-100; and Sone, T. et al. J Biotechnol. 2008 Sep. 10; 136(3-4):113-21.

In the example of human Ad5, E3 module was inserted into the pDONR P5P3r vector by gateway BP reaction. The E4 module was inserted into pDONR P3P2 vector by gateway BP reaction. The attR5-ccdB-Cm(r)-attR2 fragment from the pDONR P5P2 vector was amplified by PCR and inserted into the Adsembly DEST vector. See "MultiSite Gateway® Pro Plus", Cat#12537-100; and Sone, T. et al. J Biotechnol. 2008 Sep. 10; 136(3-4):113-21.

The vector backbone for the Adsembly DEST vector is composed of parts from three different sources. The Amp(r) cassette and lacZ gene was amplified from plasmid pUC19. This was combined with the p15A origin of replication, obtained from plasmid pSB3K5-I52002, part of the BioBricksiGEM 2007 parts distribution. The p15A ori, which maintains plasmids at a lower (10-12) copy number is necessary to reduce E1 toxicity. Lastly, in order to create a self-excising virus, the mammalian expression cassette for the enzyme I-SceI was PCR amplified from plasmid pAdZ5-CV5-E3+. This cassette was cloned into the vector backbone to create the vector called p15A-SceI. This is the vector used to start genome assembly. In the example of human Ad5, the gene modules were all obtained from either DNA purified from wild type Ad5 virus or the plasmid pAd/CMVN5/DEST (Invitrogen).

Regarding the DEST vector in the example of human Ad5, the E2 and L3 modules were inserted into plasmid p15A-SceI by 3-fragment SLIC. The counterselection marker expressing ccdB and Chlor(r) flanked by attR5 and attR2 sites was obtained by PCR from plasmid pDONR P5P2. The second counterselection marker (PheS-Tet), was obtained by PCR from the vector pDONR P1P4 PheS$^{A294G}$-Tet (see above). The two counterselection markers were inserted on the right (ccdB/Cm) and left (PheS/Tet) sides of p15A-SceI E2-L4 by SLIC after cutting with unique restriction enzymes engineered to the ends of the E2 and L4 modules to create the DEST vector.

Regarding the multisite gateway entry vector containing adenoviral gene modules, in the example of human Ad5, the E1 module were inserted into pDONR P1P4 by SLIC. The E3 module was inserted into pDONR P5P3R by gateway BP reaction. The E4 module was inserted into pDONR P3P2 by gateway BP reaction.

Regarding Amp(r) cassette: plasmid pUC19, the p15A ori: plasmid pSB3K5-I52002 was part of the BioBricksiGEM 2007 parts distribution. Regarding the adenoviral gene modules, either the DNA purified from Ad5 particles, or plasmid pAd/CMV/V5/DEST (Invitrogen). The DONR vectors pDONR P1P4, P5P2, P5P3R, P3P2 were received from Jon Chesnut (Invitrogen). The PheS gene was derived from DHSalpha bacterial genomic DNA and subsequently mutated by quick change to create the PheS$^{A294G}$ mutant. Regarding the Tet(r) gene, the plasmid pENTR L3-pLac-Tet-L2 was received from Jon Chesnut (Invitrogen).

Regarding an embodiment of the Adsembly method, 20 fmol of a dual DEST vector, typically containing a core module flanked by two counterselection cassettes, is combined with 10 fmol of each remaining entry vector containing gene modules. In the example of Ad5, this includes combining 20 fmol of the E2-L3 dual DEST vector with 10 fmol each of an E1 module entry vector, an E3 module entry vector, and an E4 module entry vector. In some cases, increasing the amount of one or more of the entry vectors may increase efficiency (e.g. using 50 fmol of the E1 module entry vector for Ad5). These vectors are combined with 2 µl of LR Clonase II (Invitrogen) in a final volume of 10 µl. The reaction is incubated at 25° C. overnight (12-16 hours). The reaction is stopped by the addition of 1 µl of proteinase K (Invitrogen) and incubation at 37° C. for 10 minutes. Five µl of the reaction is then transformed into high competency bacteria (>1e9 cfu/µg) that are sensitive to the ccdB gene product and plated onto YEG-Cl agar plates (as described in Kast, P. *Gene,* 138 (1994) 109-114; when using PheS$^{A294G}$ counterselection) or other appropriate media for the counterselection used in the vector. Colonies are subsequently isolated and screened for complete genomes.

Regarding PCRs, all PCRs were performed using the Phusion enzyme (NEB). PCRs to obtain the ADENOVIRAL GENE modules from Ad5 were performed with 1×HF buffer, 200 µM each dNTP, 0.5 µM each primer, and 10 ng of template. For the E2-L2 module, 3% DMSO was also added. Template was either plasmid pAd/PL-DEST (Invitrogen; for E2-L2, L3-L4, and E4 modules) or Ad5 genomic DNA (for E1 and E3 modules). PCR conditions were as follows. E2-L2 and L3-L4: 98° C. 30 sec-10 cycles of 98° C. 10 sec, 65° C. 30 sec (decrease temp 1° C. every 2 cycles), 72° C. 7 min-29 cycles of 98° C. 10 sec, 60° C. 30 sec, 72° C. 8 min-72° C. 10 min-4° C. hold. E3: 98° C. 30 sec-10 cycles of 98° C. 10 sec, 70° C. 30 sec (decrease temp 0.5° C. every cycle), 72° C. 2 min30 sec-25 cycles of 98° C. 10 sec, 68° C. 30 sec, 72° C. 2 min30 sec-72° C. 10 min-4° C. hold. E4: 98° C. 30 sec-6 cycles of 98° C. 10 sec, 63° C. 30 sec (decrease temp 0.5° C. every cycle), 72° C. 2 min-29 cycles of 98° C. 10 sec, 60° C. 30 sec, 72° C. 2 min-72° C. 5 min-4° C. hold.

Regarding obtaining viral genomic DNA from purified virus, up to 100 µl of purified virus is added to 300 µl of lysis buffer containing 10 mM Tris pH8, 5 mM EDTA, 200 mM NaCl, and 0.2% SDS. Mix is incubated at 60° C. for 5 min, followed by addition of 5 µl of proteinase K stock (~20 mg/mL) and further incubated at 60° C. for 1 hour. Samples are then placed on ice for 5 min, followed by spinning at 15K×g for 15 min. Supernatant is removed and added to an equal volume of isopropanol, mixed well, and spun at 15K×g for 15 min at 4° C. Pellet is washed with 70% ethanol and re-spun for 15 min at 4° C. The pellet is dried and resuspended for use.

Regarding SLIC, linear fragments are exonuclease treated for 20 min at room temp in the following 20 µl reaction: 50 mM Tris pH8, 10 mM MgCl2, 50 µg/mL BSA, 200 mM Urea, 5 mM DTT, and 0.5 µl T4 DNA polymerase. The reaction is stopped by addition of 1 µl 0.5M EDTA, followed by incubation at 75° C. for 20 min. An equal amount of T4-treated DNAs are then mixed to around 20 µl in volume in a new tube. For SLIC combining 2 fragments, 10 µl of each reaction is used. For SLIC combining 3 fragments, 7 µl of each reaction is used. Fragments are annealed by heating to 65° C. for 10 min, followed by a slow cool down decreasing the temperature 0.5° C. every 5 seconds down to 25° C. After annealing, 5 µl of the reaction is transformed and clones are screened.

Regarding AdSlicR, for the example of Ad5, a 3-fragment SLIC reaction is performed using 100 ng of T4-treated p15A-SceI (linearized by PCR), and 300 ng of each of the E2 and L3 modules (obtained by PCR from their respective entry vectors). This creates vector p15A-SceI E2-L4. Five µg of p15A-SceI E2-L4 is cut with SwaI and gel purified using Qiagen QiaexII. The E3 and E4 modules are obtained by PCR from their respective entry vectors. Each of the linearized vector (450 ng) and PCR products (200 ng) are treated with T4 DNA polymerase and SLIC performed as normal, using 150-200 ng of vector and ~100 ng of each module PCR. After isolation of positive clones, 5 µg of the new vector is cut with PacI and gel purified, then combined with an E1 PCR product (100 ng of T4-treated) in a new SLIC reaction. This completes the genome assembly, and the plasmid is ready for transfection to reconstitute virus.

B. Modified Adenoviruses

Adenoviruses are frequently used for gene transfer applications. For example, they are used to deliver transgenes to cells in culture, to animal tissue in vivo, or to human cells in vivo for gene therapy. One limiting factor in using adenoviruses in this way is gene expression is transient. Adenoviruses are non-integrating viruses, and thus the transgene expression is lost upon cell division. Other viral systems that are integrating, such as retroviruses and lentiviruses, are used for these same gene transfer purposes. However, these naturally integrating viruses are small, thus limiting the amount of transgene that can be expressed, are difficult to grow to high titers, are difficult to express multiple transgenes from, and integrate at random locations in the genome.

It has been demonstrated that the PhiC31 integrase can mediate integration of foreign circular DNA containing an ~0.280 bp attB sequence into a host cell chromosome at specific locations known as pseudo-attP sites. This process has been demonstrated using circular plasmid DNA, but has not been demonstrated with a virus such as adenovirus, likely because the adenoviral genome is linear and thus would either not integrate or would integrate causing a chromosomal break. Here we provide a system whereby a recombinant adenovirus genome is created in such a way that upon transduction, a portion of the genome becomes circular through cre-mediated recombination of loxP sites, thus allowing for targeted integration via PhiC31 integrase/attB.

Figure 31:
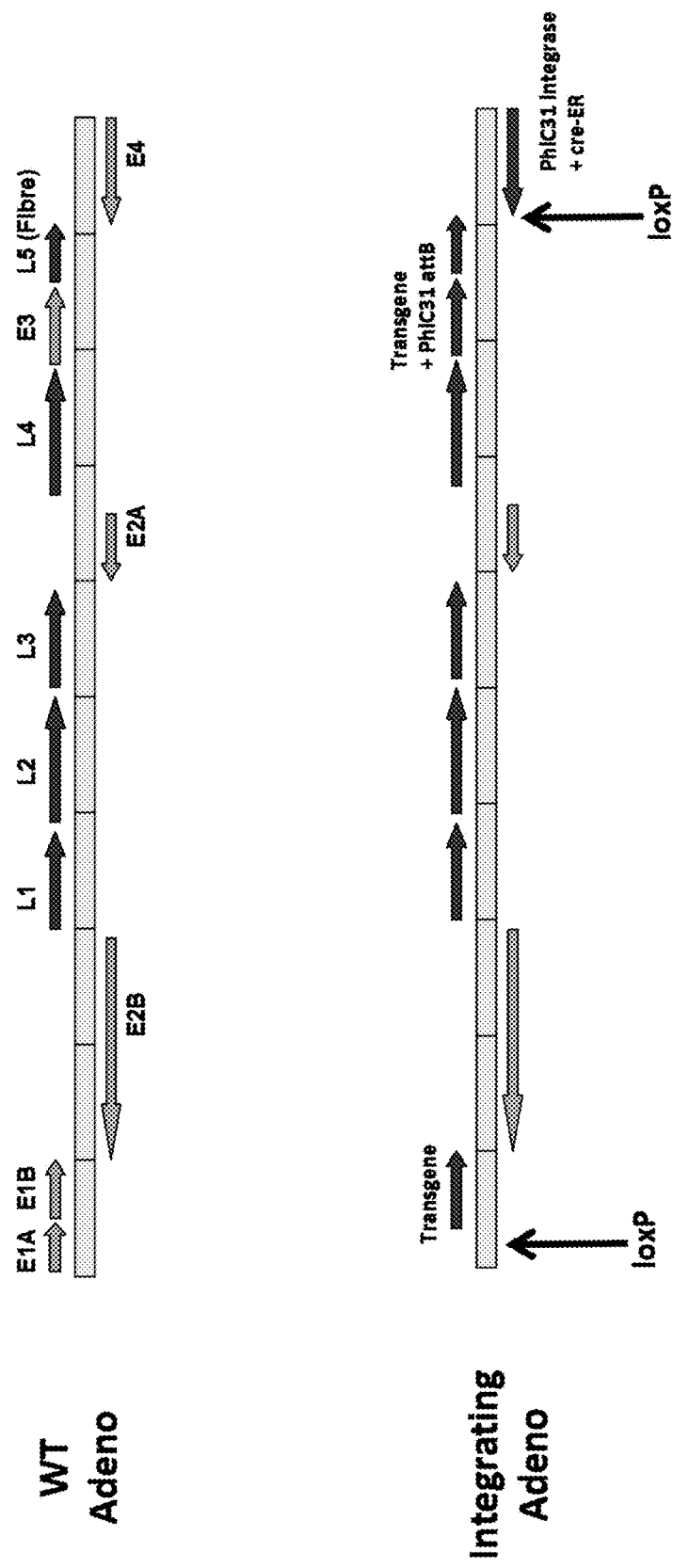
FIGS. 31-33 illustrate methods of adenoviral genome modification.
Figure 32:
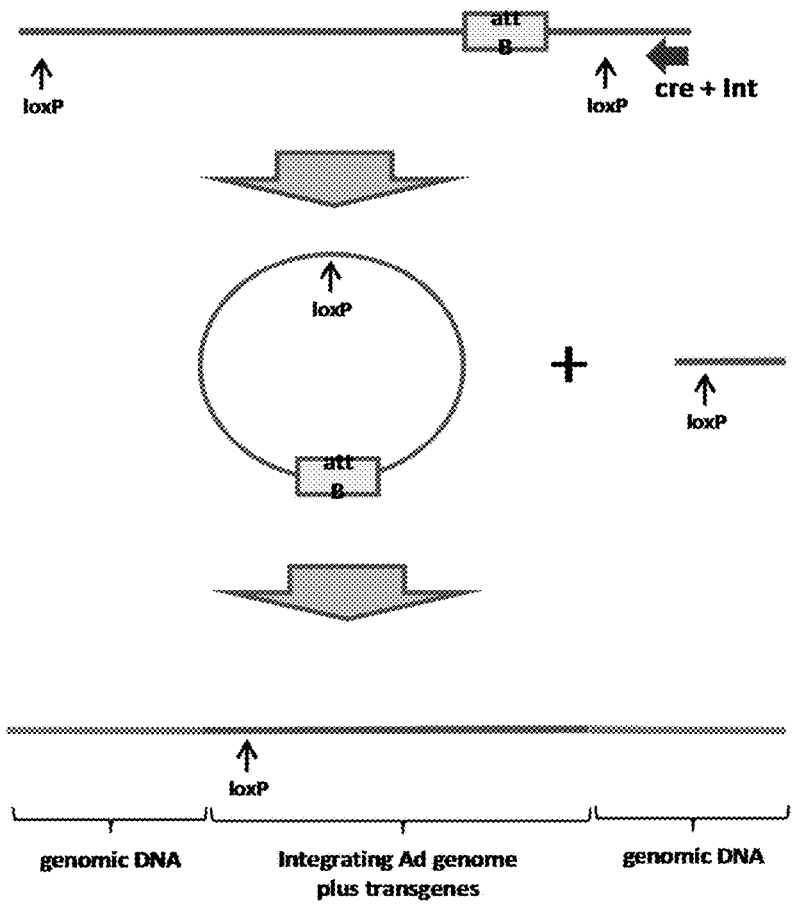
Figure 33:
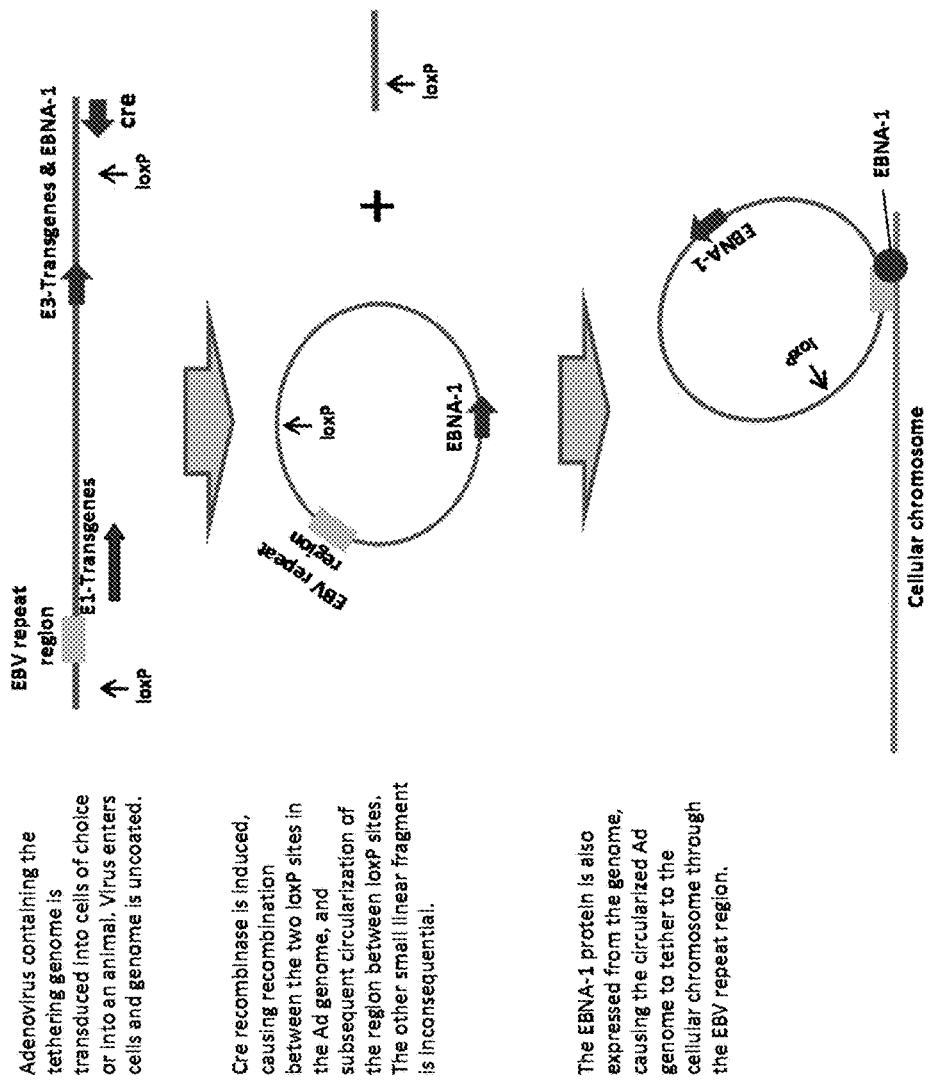
Figure 35:
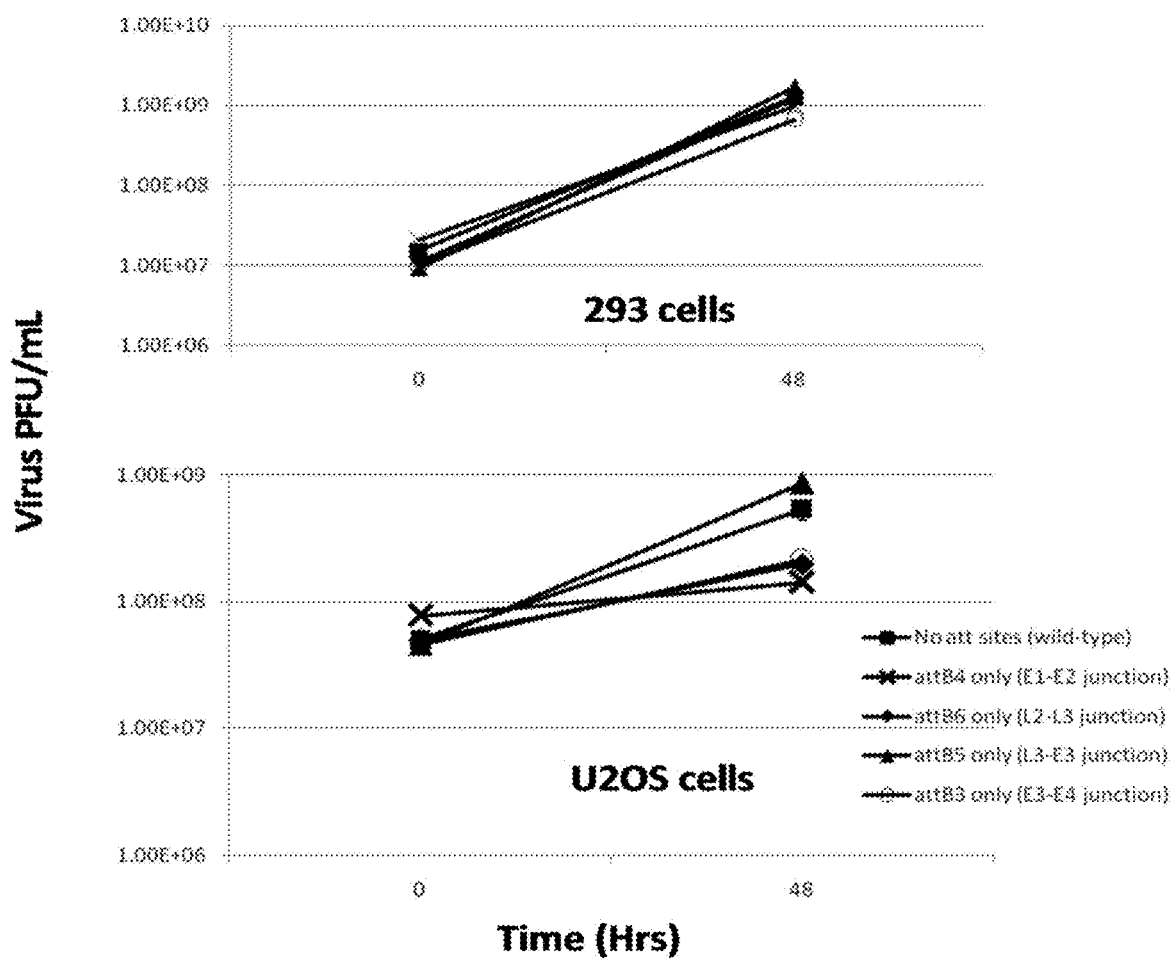
FIG. 35. Growth analysis of viruses containing single attB recombination site insertions in order to identify insertion sites that hinder growth. Since virus created using Adsembly carried a slight growth defect compared to wild type virus (FIG. 28), viruses were created using AdSLIC such that they contained only one of each the attB insertions present in viruses created using Adsembly. 293 cells (top graph) were infected at an MOI=10. U2OS cells (bottom graph) were infected at an MOI=50. Total virus was collected 48 hours later and titered. While the attB5 insertion between modules [L3] and [E3] does not hinder growth compared to wild type virus in U2OS cells, the attB insertions at the other three junctions did inhibit growth compared to wild type.
Figure 36:
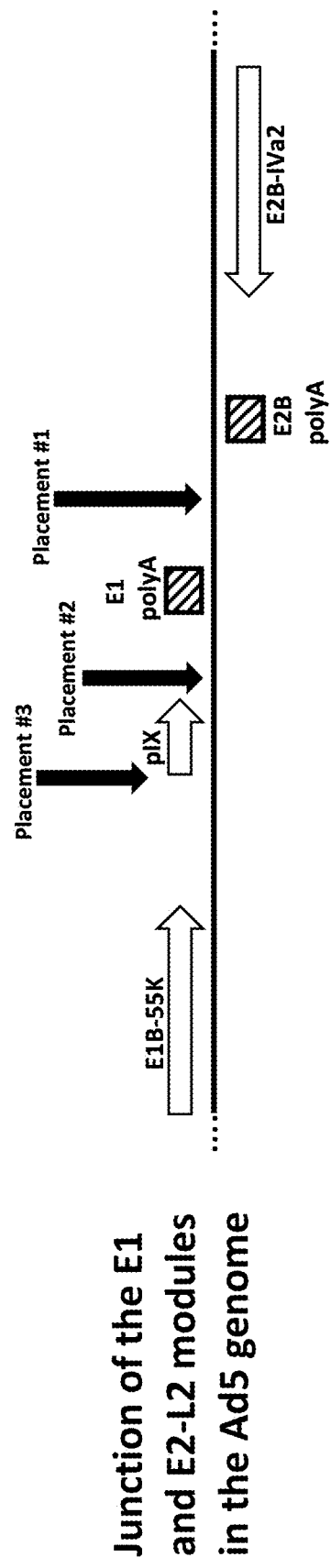
FIG. 36. Since the initial attB4 insertion site between the E1 and E2-L2 modules caused growth defects (FIG. 35), alternate placement options were designed. Base pair positions refer to positions as set forth in SEQ ID NO: 137.
Figure 37:
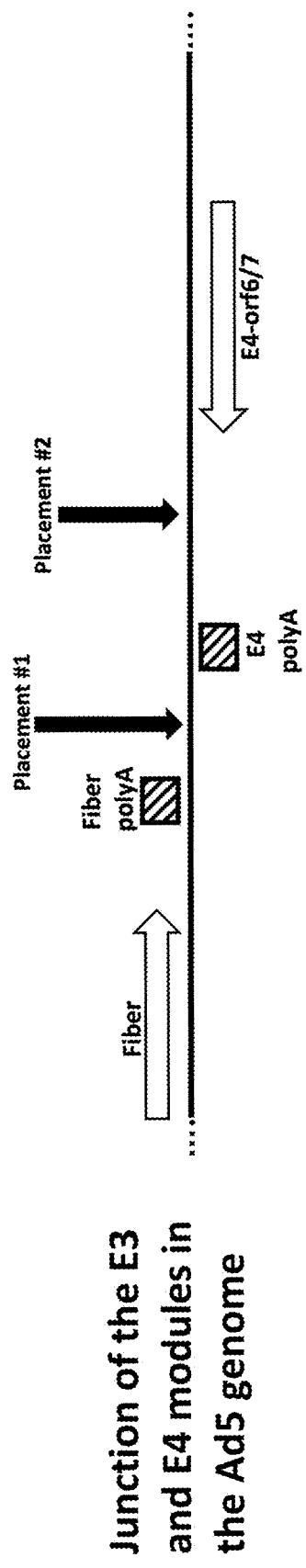
FIG. 37. Since the initial attB3 insertion site between the E3 and E4 modules caused growth defects (FIG. 35), an alternate placement was designed. Base pair positions refer to positions as set forth in SEQ ID NO: 137.
Figure 38:
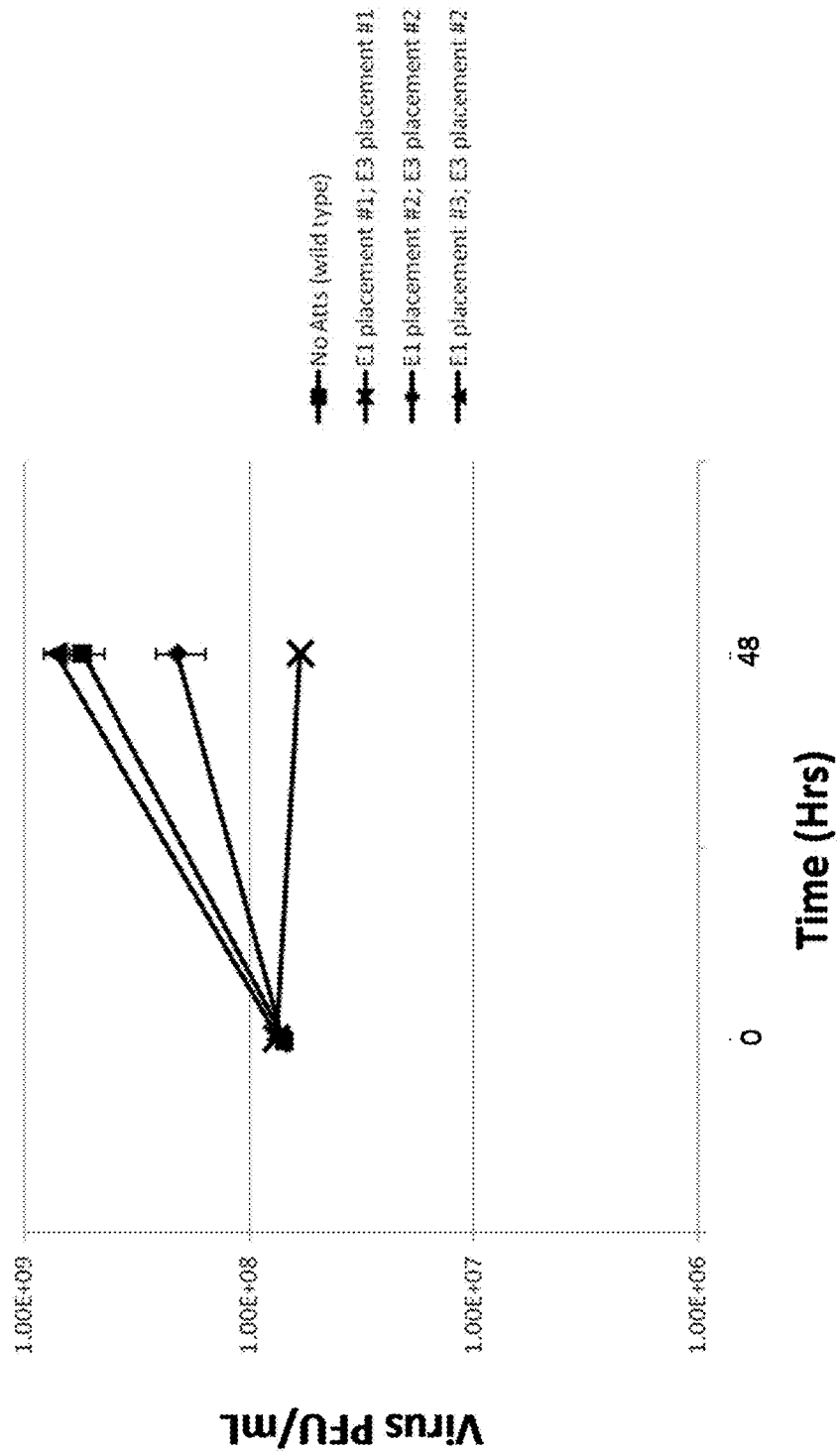
FIG. 38. U2OS cells were infected with virus at MOI=50 and total virus collected and titered after 48 hours. Three viruses created using Adsembly are compared to wild-type virus. Viruses that contain the alternate attB site insertions (black diamonds and triangles) have improved growth compared to the original attB site placements (black X's). All these viruses lack an attB site located between the L2 and L3 modules and contain the attB insertion between the L3 and E3 modules that does not affect growth.
Figure 41:
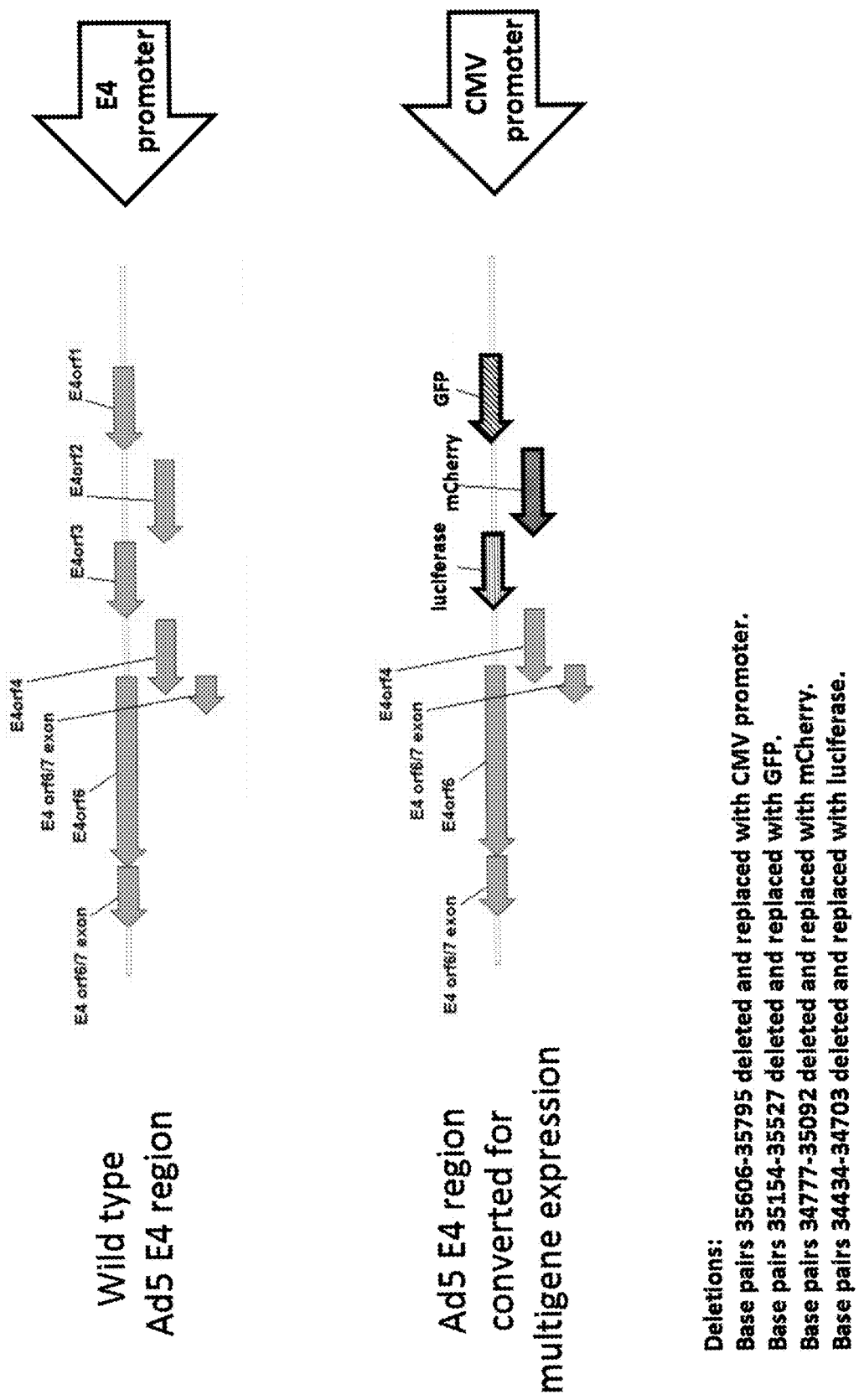
FIG. 41. Using the native viral transcriptional architecture to express multiple transgenes from the E4 module. The native E4 promoter was replaced with the CMV promoter, and 3 native E4 genes were replaced with transgenes. Adsembly was then used to create the virus. Base pair positions refer to positions as set forth in SEQ ID NO: 137.
Figure 42:
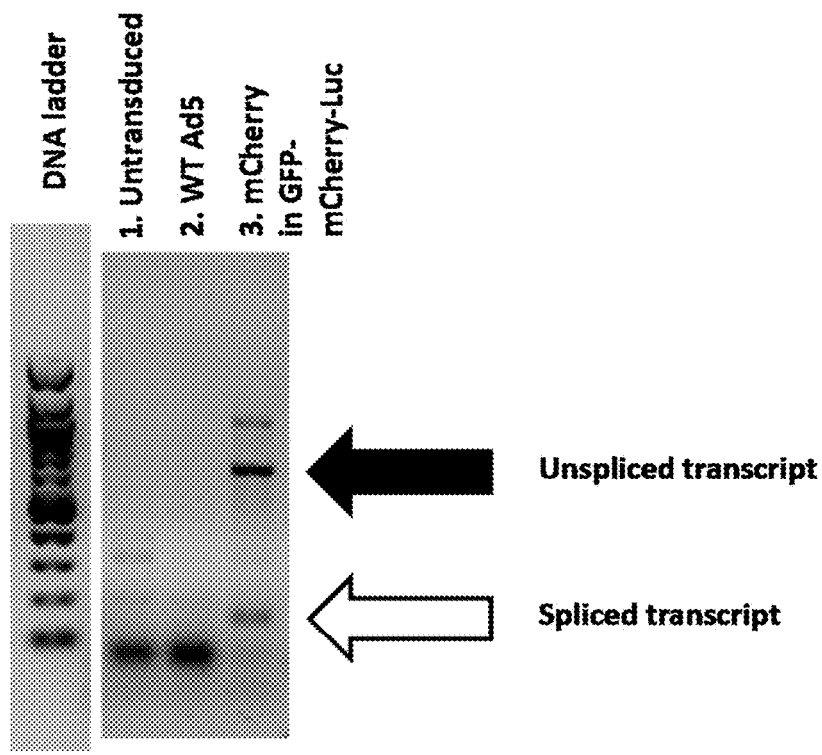
FIG. 42. Adsembly can be used to create viruses where multiple transgenes are expressed from the E4 module using the native viral transcriptional architecture. The virus created in FIG. 41 was transduced into U2OS cells for 24 hrs, total RNA was collected, cDNA was synthesized from RNA using random priming, and PCR performed to test splicing to the mCherry gene. The black arrow indicates the unspliced transcript, which will express GFP. The white arrow indicates the spliced transcript, which will express mCherry. This demonstrates multiple foreign genes can be expressed from a single module. Lanes 1 and 2 are negative controls of untransduced cells or cells infected with wild type Ad5, respectively.
Figure 43:
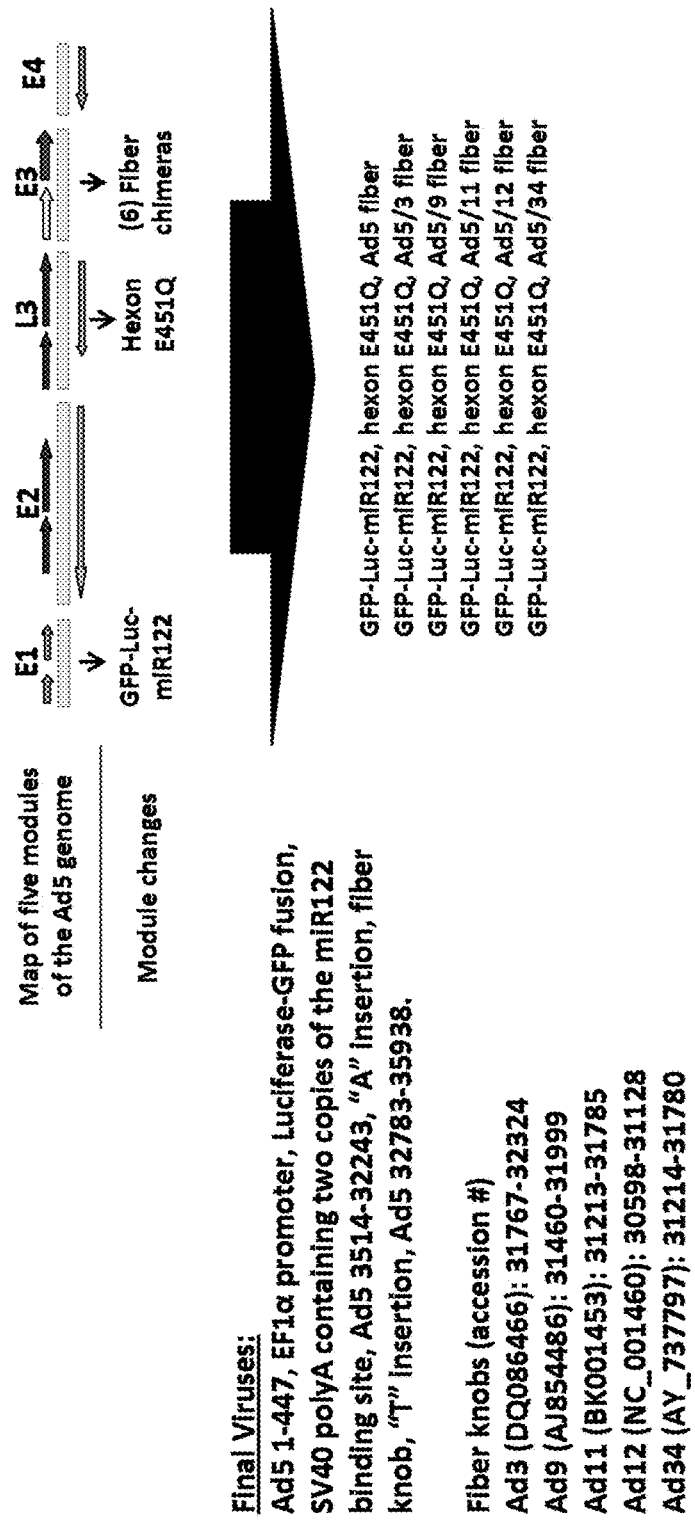
FIG. 43. Incorporating multiple types of changes across multiple modules in single genome assemblies using Adsembly. A diagram displaying the five modules of the Ad5 genome with vertical arrows indicating the changes made to each module prior to full genome assembly. The E1 module was converted into a transgene expression cassette for a luciferase-GFP fusion protein. The hexon protein in the L3 module was altered at Glu 451 to Gln by point mutation. A portion of the native Ad5 fiber in the E3 module was replaced with one of several fiber portions from other human adenovirus serotypes. Six viruses were created using Adsembly, each with an alternate fiber protein. Base pair positions listed for Ad5 refer to positions as set forth in SEQ ID NO: 137. Accession numbers DQ086466, AJ854486, BK001453, NC_001460, and AY_737797 correspond to SEQ ID NOs: 139-143, respectively.
Figure 46:
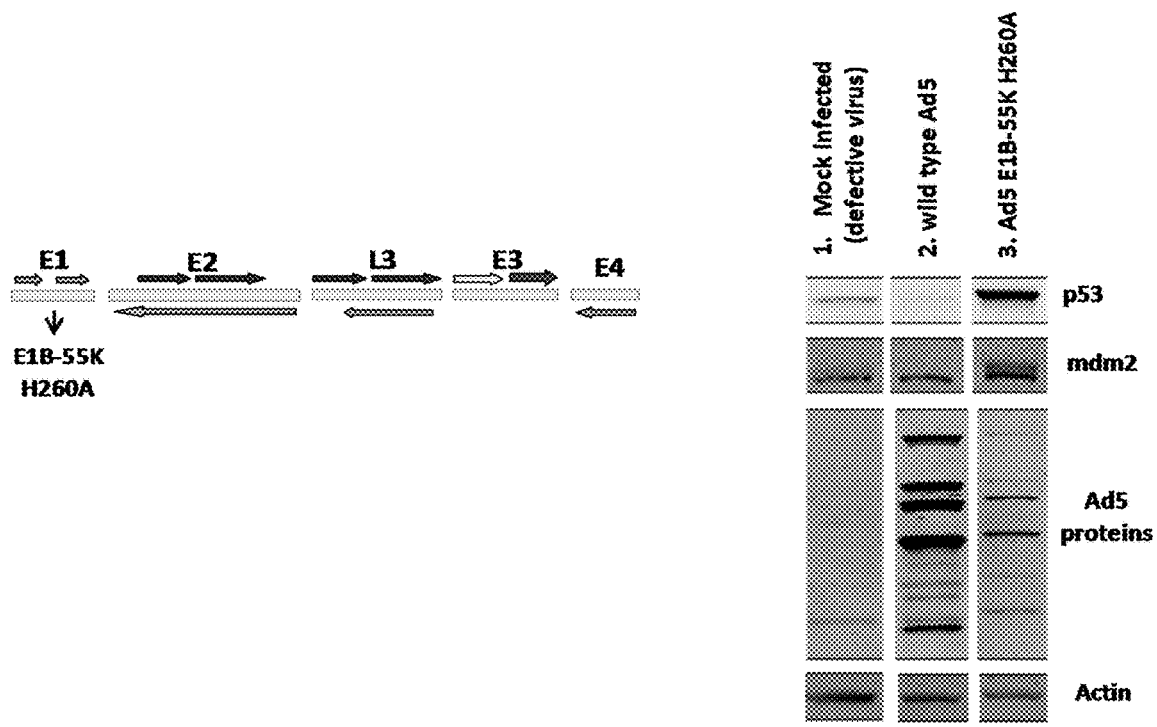
FIG. 46. Using AdSLIC to make mutations in viral genes in order to study their function in the context of virus infection. In the E1 module, the E1B-55K gene was mutated at the His 260 position to Ala. All other modules were wild type. This virus was assembled using AdSLIC. Human small airway epithelial cells were infected at MOI=10 with either replication defective Ad5 (lane 1), wild type Ad5 (lane 2), or Ad5 H260A (lane 3). Total protein was collected at 36 hours post infection and analyzed by western blot for p53 (top panel), mdm2, Ad5 late proteins, and actin. Unlike the wild type Ad5, the Ad5-H260A virus is unable to degrade p53 and has a defect in production of late proteins.

For this technology, the Adenoviral genome is modified in several ways (see FIGS. 31-33). First, the E1 and E3 regions are deleted to allow for multiple transgene expression. The E4 region is replaced with a cassette expressing the cre recombinase and the PhiC31 integrase. The expression of these enzymes is regulated using a tet-responsive promoter or other similar regulatable element. Two loxP sites are placed in the genome, one on the left end of the E1 region where the transgene is expressed, and the second between the fiber and the E4 region. Thus, everything in between these two loxP sites will be inserted into the cellular chromosome. Lastly, the PhiC31 attB site is placed within the E3 region, although the particular placement of this short sequence can be at other locations as long as it is between the loxP sites. (Although in this example the cre recombinase and PhiC31 integrase are expressed from the same adenovirus that contains the loxP sites and transgenes, one could also express those enzymes from a separate virus.)

Upon transduction of the adenovirus into cells, the cre recombinase and PhiC31 integrase are induced. Cre facilitates the recombination of the loxP sites in the adenovirus genome. This leads to the circularization of the DNA located between the loxP sites. This then allows for the integrase to recombine the circular fragment into the cellular chromosome using the attB site in the fragment (see FIG. 33). The end result is the stable (non-reversible) integration of a selected portion of the adenovirus genome into the host cell chromosome at one of a limited number of locations. The transgenes are stably expressed from this integration. There is no risk of adenovirus replication or reactivation since 1) the E1 region is deleted and 2) the ends of the viral genome are deleted in the process. Both of these regions are necessary for virus transcription and replication.

Advantages of this system over existing retrovirus and lentivirus systems include 1) integration at a limited number of locations within the genome rather than being random, 2) increased size allowance for transgene expression, 3) the ability to retarget the adenovirus to specific cells or tissues through fiber modifications (FIGS. 39-42) or the use of other adenovirus serotypes and species (FIG. 45), 4) ease of manipulation using the Adsembly system, 5) ease of production of high-titer virus, and 6) ease of multigene expression from a single vector.

This system advances on the current PhiC31 integration technology (sold by Life Technologies as the "Jump-In" line of products) by the use of viral-mediated DNA delivery. The existing technology is only plasmid-based, and thus is limited to cells that can be transfected or electroporated efficiently. Plus it cannot be used in vivo unless specific transgenic mice are created. Adenovirus is routinely used to deliver transgenes in vivo, and thus this greatly expands the capabilities of the existing technology. One incarnation would be the creation of mouse models using multi-gene expression cassettes via titratable and targeted delivery of a modified adenovirus to specific tissues. Another incarnation would be to mouse-line containing an att site for targeted knock-in. Another incarnation would be for iPS.

C. Creation of a Complete Near Wild-Type Adenovirus Type 5 Using Adsembly

Adsembly was used to construct a near wild-type version of Ad5 using the following strategy. A wild-type core sequence flanked by gateway counterselection cassettes was mixed with a wild-type Ad5 E1 module, a wild-type Ad5 E3 module, and a wild-type Ad5 E4 module (FIG. 21). A clone that contained a completely assembled genome was isolated and transfected into 293 cells. Plaques were visible after 7 days, and the virus was harvested and amplified on more 293 cells. Growth analysis revealed that this near wild-type virus (it contains 3 attB insertions compared to a true wild-type virus) grew to only slightly reduced titers as a true wild-type virus (FIG. 28).

D. Creation of a Mutant Ad5 that is Replication Defective, Expressed GFP, and Contains a Fiber Protein from an Alternate Serotype We created a mutant Ad5 using Adsembly. The Ad5 E1 module was altered such that the E1A and E1B regions were deleted, thus rendering any virus made with this new vector replication defective. After removal of E1A and E1B, a mammalian expression cassette was inserted containing the CMV IE promoter and the GFP gene. The Ad5 E3 module was altered such that the Ad5 fiber gene was replaced with the fiber gene from Ad34. These mutant E1 and E3-fiber modules were combined with a wild-type Ad5 E4 module and a wild-type Ad5 core module flanked by gateway counterselection cassettes in a standard Adsembly reaction (FIG. 21). A resulting clone that was a complete assembled genome was isolated and transfected into 293 cells. Plaques were visible after 7 days, and the virus was harvested and amplified on more 293 cells. Growth of this virus indicates that this strategy can be used for 1) transgene expression, 2) fluorescent gene expression, 3) replication defective virus construction, 4) chimeric adenovirus creation, and 5) alternate fiber expression in an Ad5 background.

E. Creation of a Replication Competent Ad5 Using AdSlicR.

AdSlicR was used to construct a wild-type Ad5 from adenoviral gene modules. The wild-type E3 and E4 modules were obtained by PCR from their adenoviral gene module vectors. These were combined with a SwaI-cut wild-type Ad5 core module in a standard SLIC reaction (FIG. 25). A clone that successfully contained the core module with the E3 and E4 modules was isolated and cut with PacI. This was then combined in a second SLIC reaction with a wild-type Ad5 E1 module obtained by PCR from the adenoviral gene module vector. A clone containing a completely assembled genome was isolated and transfected into 293 cells. Plaques were visible by day 7. The resulting virus was amplified on more 293 cells. Growth analysis of this virus revealed that it grows to the same titers as wild-type Ad5 (FIG. 28).

V. Tables

Tables 1-9 disclose examples of adenoviral gene module vectors, destination vectors and entry vectors prepared using the methods provided herein.

TABLE 1

| ID | method/ technique | Expression | Mutations | Components E1 |
|---|---|---|---|---|
| PTFL-100 | Adsembly | | WT | 001 |
| PTFL-101 | Adsembly | | WT | 001 |
| PCMN-102 | AdSLIC | | WT | 001 |
| PCMN-103 | AdSLIC | | WT | 001 |
| PCMN-104 | AdSLIC | | WT | 001 |
| PCMN-105 | AdSLIC | | WT | 001 |
| PCMN-106 | AdSLIC | | WT | 001 |
| PCMN-107 | AdSLIC | | WT | 001 |
| PCMN-108 | AdSLIC | | WT | 001 |
| PCMN-109 | AdSLIC | | E1B55K-H260A | 005 |

TABLE 1-continued

| ID | Method | Transgene | Description | Code |
|---|---|---|---|---|
| PCMN-110 | AdSLIC | | E4orf3-I104R | 001 |
| PCMN-111 | AdSLIC | | E1B55K-H260A; E4ORF3-I104R | 005 |
| PTFL-112 | Adsembly | IRES-GFP | ΔE1-CMV-IRES-GFP | 007 |
| PTFL-113 | Adsembly | IRES-GFP | ΔE1-CMV-IRES-GFP; Ad34 fiber | 007 |
| PCMN-117 | AdSLIC | CMV-GFP | ΔE1/ΔE4ORF3 | 016 |
| PCMN-118 | AdSLIC | | ΔE4ORF3 | 001 |
| PTFL-120 | Adsembly | CMV-GFP | ΔE1-CMV-GFP | 009 |
| PTFL-121 | Adsembly | CMV-GFP | ΔE1-CMV-GFP; Ad34 fiber | 009 |
| PTFL-123 | Adsembly | CMV-GFP | ΔE1-CMV-GFP; Ad5/3 fiber tail/KS | 009 |
| PCMN-124 | AdSLIC | | ΔE1B-55K | 012 |
| PCMN-125 | AdSLIC | CMV-ORF3 | ΔE1/ΔE4ORF3 | 016 |
| PCMN-126 | AdSLIC | CMV-ORF3 N82A | ΔE1/ΔE4ORF3 | 016 |
| PCMN-127 | AdSLIC | CMV-ORF3 EK4 | ΔE1/ΔE4ORF3 | 016 |
| PCMN-128 | AdSLIC | CMV-Myc-ORF3 | ΔE1/ΔE4ORF3 | 017 |
| PCMN-129 | AdSLIC | CMV-C4-ORF3 | ΔE1/ΔE4ORF3 | 016 |
| PTFL-131 | Adsembly | | WT | 001 |
| PCMN-132 | AdSLIC | CMV-GFP | ΔE1-CMV-GFP; pIX C-term 6x His | 010 |
| PTFL-133 | Adsembly | EF1α-[luc-GFP fusion] | ΔE1-EF1α-[luc-GFP]-miR122 | E1-015 |
| PTFL-134 | Adsembly | EF1α-[luc-GFP fusion] | ΔE1-EF1α-[luc-GFP]-miR122; fiber chimera Ad5/3/3 | E1-015 |
| PTFL-135 | Adsembly | EF1α-[luc-GFP fusion] | ΔE1-EF1α-[luc-GFP]-miR122; fiber chimera Ad5/9/9 | E1-015 |
| PTFL-136 | Adsembly | EF1α-[luc-GFP fusion] | ΔE1-EF1α-[luc-GFP]-miR122; fiber chimera Ad5/12/12 | E1-015 |
| PTFL-138 | Adsembly | EF1α-[luc-GFP fusion] | ΔE1-EF1α-[luc-GFP] | E1-014 |
| PCMN-140 | AdSLIC | | ΔE1b-55k/ΔOrf3 | E1-012 |
| PTFL-144 | Adsembly | eGFP | ΔE1-GFP | E1-020 |
| PTFL-147 | Adsembly | EF1α-[luc-GFP fusion] | ΔE1-EF1α-[luc-GFP]-miR122 | E1-015 |
| PTFL-148 | Adsembly | EF1α-[luc-GFP fusion] | ΔE1-EF1α-[luc-GFP]-miR122; fiber chimera Ad5/3/3 | E1-015 |
| PTFL-149 | Adsembly | EF1α-[luc-GFP fusion] | ΔE1-EF1α-[luc-GFP]-miR122; fiber chimera Ad5/9/9 | E1-015 |
| PCMN-152 | AdSLIC | | ΔE1B-55K; E4orf3-I104R | E1-012 |
| PCMN-157 | AdSLIC | | ΔE1B-55K; E4orf3-N82A | E1-012 |
| PCMN-158 | AdSLIC | | ΔE1B-55K; E4orf3-E10K/E52K/E53K/H55K | E1-012 |
| PCMN-159 | AdSLIC | | Ad11 capsid with Ad5 E1, E3, E4 | E1-023 |
| PCMN-160 | AdSLIC | mCherry | ΔADP | E1-001 |
| PCMN-161 | AdSLIC | mCherry-ADP | ΔADP + mCherry ADP | E1-001 |
| PCMN-162 | AdSLIC | | ΔE1B-55K; E4orf3-Ad9 | |
| PCMN-163 | AdSLIC | | ΔE1B-55K; E4orf3-Ad12 | |
| PCMN-164 | AdSLIC | | ΔE1B-55K; E4orf3-Ad34 | |
| PCMN-165 | AdSLIC | | ΔE1B-55K; E4orf3-E10A/E52A/E53A/H55A | E1-012 |
| PCMN-166 | AdSLIC | CMV-ORF3 EA4 | E4orf3-E10A/E52A/E53A/H55A | 016 |
| PCMN-167 | AdSLIC | none | Ad9 capsid with Ad5 E1, E3, E4 | E1-025 |
| PCMN-168 | AdSLIC | none | Ad12 capsid with Ad5 E1, E3, E4 | E1-026 |
| PA-169 | Adsembly | none | WT (version 3) | E1-027 |
| PA-170 | Adsembly | none | WT (version 4) | E1-028 |
| PA-171 | Adsembly | EF1α-[luc-GFP fusion] | ΔE1-EF1α-[luc-GFP]-miR122; hexon E451Q | E1-029 |
| PA-172 | Adsembly | EF1α-[luc-GFP fusion] | ΔE1-EF1α-[luc-GFP]-miR122; fiber chimera Ad5/5/3, hexon E451Q | E1-029 |
| PA-173 | Adsembly | EF1α-[luc-GFP fusion] | ΔE1-EF1α-[luc-GFP]-miR122; fiber chimera Ad5/5/9 hexon E451Q | E1-029 |
| PA-174 | Adsembly | EF1α-[luc-GFP fusion] | ΔE1-EF1α-[luc-GFP]-miR122; fiber chimera Ad5/5/11 hexon E451Q | E1-029 |
| PA-175 | Adsembly | EF1α-[luc-GFP fusion] | ΔE1-EF1α-[luc-GFP]-miR122; fiber chimera Ad5/5/12 hexon E451Q | E1-029 |
| PA-176 | Adsembly | EF1α-[luc-GFP fusion] | ΔE1-EF1α-[luc-GFP]-miR122; fiber chimera Ad5/5/34 hexon E451Q | E1-029 |
| PCMN-184 | AdSLIC | E3-mCherry | ΔE3-12.5K + mCherry | x |
| PCMN-186 | AdSLIC | | ΔE1B-19k | E1-035 |
| PCMN-187 | AdSLIC | | ΔE1B-19k, ΔE1B-55k | E1-036 |
| PCMN-188 | AdSLIC | | ΔE1B-19k, ΔE1B-55k, ΔE4-ORF3 | E1-036 |
| PCMN-189 | AdSLIC | | E1A ΔLXCXE | E1-021 |
| PCMN-190 | AdSLIC | | E1A ΔLXCXE, ΔE1B-55k | E1-030 |
| PCMN-191 | AdSLIC | | E1A ΔLXCXE, ΔE1B-55k, ΔE4-ORF3 | E1-030 |
| PCMN-192 | AdSLIC | | E1A Δ2-36 | E1-022 |
| PCMN-193 | AdSLIC | | E1A Δ2-36, ΔE1B-55k | E1-037 |
| PCMN-194 | AdSLIC | | E1A Δ2-36, ΔE1B-55k, ΔE4-ORF3 | E1-037 |
| PCMN-195 | AdSLIC | GFP-E1A | GFP-E1A | E1-031 |
| PCMN-196 | AdSLIC | pIX-Flag-GFP | pIX-Flag-GFP | E1-034 |
| PCMN-197 | AdSLIC | none | E1A ΔLXCXE; Ad5/9 capsid swap | E1-041 |
| PCMN-198 | AdSLIC | none | E1A ΔLXCXE; Ad5/11 capsid swap | E1-042 |
| PA-199 | Adsembly | EF1α-[luc-GFP fusion] | ΔE1-EF1α-[luc-GFP] | E1-044 |
| PA-200 | Adsembly | EF1α-[luc-GFP fusion] | ΔE1-EF1α-[luc-GFP]-miR122 | E1-029 |
| PCMN-201 | AdSLIC | | Ad3 capsid with Ad5 E1, E3, E4 | E1-039 |
| PCMN-202 | AdSLIC | | Ad34 capsid with Ad5 E1, E3, E4 | E1-004 |

TABLE 1-continued

| ID | Components | | | AdSLIC | Notes |
| | E3 | E4 | core | Macromodule | |
|---|---|---|---|---|---|
| PTFL-100 | 001 | 001 | 002 | | pUV12 build. Contains all 4 attB sites. |
| PTFL-101 | 001 | 001 | 001 | | pUV3 build. Only attB4, attB5, attB3. |
| PCMN-102 | 001 | 001 | 001 | 001 | Compared to WT Ad5, contains "TA" insertion at 4076bp and "T" at 27173bp. |
| PCMN-103 | 001 | 001 | 001 | 001 | Contains the attB4 insertion only |
| PCMN-104 | 001 | 001 | 002 | | Contains the attB6 insertion only |
| PCMN-105 | 001 | 001 | 001 | | Contains the attB5 insertion only |
| PCMN-106 | 001 | 001 | 001 | | Contains the attB3 insertion only |
| PCMN-107 | 001 | 001 | 002 | | Contains attB4, attB6, and attB3 insertions |
| PCMN-108 | 001 | 001 | 001 | | Contains attB4 and attB3 insertions |
| PCMN-109 | 001 | 001 | 001 | 001 | |
| PCMN-110 | 001 | 005 | 001 | 003 | |
| PCMN-111 | 001 | 005 | 001 | 004 | |
| PTFL-112 | 003 | 001 | 002 | | Contains all 4 attB insertions |
| PTFL-113 | 004 | 001 | 002 | | Contains all 4 attB insertions |
| PCMN-117 | 001 | 006 | 001 | 007 | GFP via R.Shaw |
| PCMN-118 | 001 | 006 | 001 | 007 | |
| PTFL-120 | 001 | 001 | 001 | | |
| PTFL-121 | 004 | 001 | 001 | | |
| PTFL-123 | 009 | 001 | 001 | | Contains a chimeric fiber with the Ad5 tail and Ad3 knob and shaft |
| PCMN-124 | 001 | 001 | 001 | 001 | |
| PCMN-125 | 001 | 006 | 001 | 007 | |
| PCMN-126 | 001 | 006 | 001 | 007 | |
| PCMN-127 | 001 | 006 | 001 | 007 | |
| PCMN-128 | 001 | 006 | 001 | 007 | |
| PCMN-129 | 001 | 006 | 001 | 007 | |
| PTFL-131 | 001 | 008 | 001 | | Lacks the repeat sequence between E3-E4 present in previous Adsembled viruses |
| PCMN-132 | 001 | 001 | 001 | 001 | |
| PTFL-133 | E3-001 | E4-001 | core-003 | | |
| PTFL-134 | E3-009 | E4-001 | core-003 | | Fiber chimera Ad5 tail, Ad3 shaft/knob |
| PTFL-135 | E3-010 | E4-001 | core-003 | | Fiber chimera Ad5 tail, Ad9 shaft/knob |
| PTFL-136 | E3-011 | E4-001 | core-003 | | Fiber chimera Ad5 tail, Ad12 shaft/knob |
| PTFL-138 | E3-001 | E4-001 | core-003 | | Control virus lacking miR122 sites to test their function. Compare to PTFL-133. |

TABLE 1-continued

| | | | | | |
|---|---|---|---|---|---|
| PCMN-140 | | E4-006 | | ASMM-006 | 3112 equivalent in adslic system |
| PTFL-144 | E3-001 | E4-001 | core-001 | | eGFP ORF replaces the start codon of E1A to the stop codon of E1B-55K |
| PTFL-147 | E3-001 | E4-001 | core-001 | | WT core. This is to compare to the hexon E451Q core with PTFL-133. |
| PTFL-148 | E3-009 | E4-001 | core-001 | | WT core. This is to compare to the hexon E451Q core with PTFL-134. |
| PTFL-149 | E3-010 | E4-001 | core-001 | | WT core. This is to compare to the hexon E451Q core with PTFL-135. |
| PCMN-152 | E3-001 | E4-005 | core-001 | ASMM-004 | |
| PCMN-157 | E3-001 | E4-011 | core-001 | | |
| PCMN-158 | E3-001 | E4-012 | core-001 | | |
| PCMN-159 | E3-026 | E4-001 | core-004 | | Contains all structural proteins of Ad11 with the E1, E3, and E4 proteins of Ad5. |
| PCMN-160 | E3-024 | E4-001 | | ASMM-002 | ADP ORF replaced with mCherry ORF |
| PCMN-161 | E3-025 | E4-001 | | ASMM-002 | ADP ORF replaced with mCherry-ADP fusion ORF |
| PCMN-162 | | E4-015 | | ASMM-006 | E4-ORF3 from Ad9 replaces the E4-ORF3 from Ad5 |
| PCMN-163 | | E4-016 | | ASMM-006 | E4-ORF3 from Ad12 replaces the E4-ORF3 from Ad5 |
| PCMN-164 | | E4-017 | | ASMM-006 | E4-ORF3 from Ad34 replaces the E4-ORF3 from Ad5 |
| PCMN-165 | E3-001 | E4-012 | core-001 | | |
| PCMN-166 | 001 | 006 | 001 | | |
| PCMN-167 | E3-034 | E4-001 | core-005 | | Contains all structural proteins of Ad9 with the E1, E3, and E4 proteins of Ad5. |
| PCMN-168 | E3-035 | E4-001 | core-006 | | Contains all structural proteins of Ad12 with the E1, E3, and E4 proteins of Ad5. Fully sequenced. |
| PA-169 | E3-036 | E4-018 | core-007 | | WT Adsembly version 3 virus. |
| PA-170 | E3-036 | E4-018 | core-008 | | WT Adsembly version 4 virus. |
| PA-171 | E3-036 | E4-018 | core-009 | | Adsembly version 3 virus |
| PA-172 | E3-037 | E4-018 | core-009 | | Adsembly version 3 virus |
| PA-173 | E3-038 | E4-018 | core-009 | | Adsembly version 3 virus |
| PA-174 | E3-039 | E4-018 | core-009 | | Adsembly version 3 virus |
| PA-175 | E3-040 | E4-018 | core-009 | | Adsembly version 3 virus |
| PA-176 | E3-041 | E4-018 | core-009 | | Adsembly version 3 virus |

TABLE 1-continued

|  |  |  |  |  |
|---|---|---|---|---|
| PCMN-184 | E3-042 | E4-001 | x | ASMM-002 |
| PCMN-186 | x | x | x | ASMM-001 |
| PCMN-187 | x | x | x | ASMM-001 |
| PCMN-188 | x | x | x | ASMM-007 |
| PCMN-189 | x | x | x | ASMM-001 |
| PCMN-190 | x | x | x | ASMM-001 | remaking (Jul. 3, 2011) |
| PCMN-191 | x | x | x | ASMM-007 | remaking (Jul. 3, 2011) |
| PCMN-192 | x | x | x | ASMM-001 |
| PCMN-193 | x | x | x | ASMM-001 |
| PCMN-194 | x | x | x | ASMM-007 | cloning in process . . . (May 31, 2011) |
| PCMN-195 | x | x | x | ASMM-001 | cloning in process . . . (May 31, 2011) |
| PCMN-196 | x | x | x | ASMM-001 | cloning in process . . . (May 31, 2011) |
| PCMN-197 |  |  |  | ASMM-014 |
| PCMN-198 |  |  |  | ASMM-013 |
| PA-199 | E3-036 | E4-018 | core-007 |  | aka, Ad5-ELG |
| PA-200 | E3-036 | E4-018 | core-007 |  | aka, Ad5-ELGM |
| PCMN-201 | E3-045 | E4-001 | core-011 |  |
| PCMN-202 | E3-046 | E4-001 | core-012 |  |

TABLE 2

VIRUSES AdSLIC Macromodules

| ID | Serotype | Mutations | Parental E1 | Adsembly version | Comments | Plasmid Map |
|---|---|---|---|---|---|---|
| E1-001 | Ad5 | None |  | Original | WT E1 region obtained from Ad5 viral DNA |  |
| E1-002 | Ad34 | None |  | Original | WT E1 region obtained from Ad34 viral DNA |  |
| E1-003 | Ad5 | None |  | Original | Contains PacI next to ITR rather than I-SceI |  |
| E1-004 | Ad34 | None |  | Original | Contains PacI next to ITR rather than I-SceI |  |
| E1-005 | Ad5 | 55K-H260A | 001 | Original | H260A mutation in E1B-55K (CAC->GCC) |  |
| E1-006 | Ad5 | ΔE1A/E1B | 001 | Original | Lacks bp 448-3513 of the Ad5 genome. Replaced with PacI-PmeI-AscI SLIC MCS. |  |
| E1-007 | Ad5 | ΔE1A/E1B + CMV-MCS-IRES2-GFP | 006 | Original | The CMV-MCS-IRES-GFP-SV40pA fragment was PCR'd from plasmid pIRES2-eGFP and SLIC'd into the PacI site of ΔE1A/E1B. |  |
| E1-008 | Ad5 | ΔE1A/E1B + CMV promoter | 006 | Original | The CMV-MCS from plasmid pIRES2-eGFP was SLIC'd into the PacI site of ΔE1A/E1B. |  |
| E1-009 | Ad5 | ΔE1A/E1B + CMV-eGFP | 008 | Original | eGFP was inserted using SLIC. |  |
| E1-010 | Ad5 | ΔE1A/E1B + CMV-eGFP; His tag on pIX | 009 | Original | SAHHHHHH added to the C-term of pIX |  |
| E1-011 | Ad5 | His tag on pIX | 001 | Original | SAHHHHHH added to the C-term of pIX |  |
| E1-012 | Ad5 | ΔE1B-55K | 001 | Original | 55K ATG mutated to GTG and I90stop (ATT -> TAG) |  |
| E1-013 | Ad5 | ΔE1A/E1B + EF1α-eGFP | 009 | Original | EF1α promoter PCR'd from plasmid pEX-EF1-CFP-VAMP2 and SLIC'd into E1-009 which had been PCR'd to lack the CMV promoter |  |
| E1-014 | Ad5 | ΔE1A/E1B + EF1α-(luciferase-eGFP fusion) | 013 | Original | Luciferase PCR'd from plasmid pBV-luc. A linker of Ala-Ala-Ala-Ala-Thr added between luc and GFP |  |
| E1-015 | Ad5 | ΔE1A/E1B + EF1α-(luciferase-eGFP fusion)-miR122 | 014 | Original | Two miR122 recognition sites added in the 3'UTR, spaced by ATCGATT. |  |
| E1-016 | Ad5 | CMV attR1-Cm-attR2 |  | Original | E1 replaced by CMV attR1-Cm-attR2 from pAd/CMV/V5 Dest vector |  |
| E1-017 | Ad5 | CMV Myc epitope-attR1-Cm-attR2 |  | Original | E1 replaced by CMV Myc epitope-attR1-Cm-attR2 from pAd/CMV/V5 Dest vector |  |
| E1-018 | Ad5 | CMV Flag epitope-attR1-Cm-attR2 |  | Original | E1 replaced by CMV Flag epitope-attR1-Cm-attR2 from pAd/CMV/V5 Dest vector |  |
| E1-019 | Ad5 | ΔpIX + PacI site | E1-001 | Original | pIX deleted and replaced by a PacI site. Cut with PacI and SLIC in other pIX genes. |  |
| E1-020 | Ad5 | ΔE1A/E1B + eGFP | E1-001 | Original | (start codon of E1A to stop codon of E1B 55k replaced with eGFP ORF) |  |

TABLE 2-continued

VIRUSES AdSLIC Macromodules

| ID | Serotype | Mutations | Parental E1 | Adsembly version | Comments | Plasmid Map |
|---|---|---|---|---|---|---|
| E1-021 | Ad5 | E1A ΔLXCXE | E1-001 | Original | deleted LXCXE in E1A | |
| E1-022 | Ad5 | E1A Δ2-36 | E1-001 | Original | deleted residues 2-36 in E1A (p21 binding region, PDZ domain) | |
| E1-023 | Ad5/11 | Ad5 with Ad11 pIX | E1-019 | Original | pIX from Ad11 was SLIC'd into PacI-cut E1-019 | |
| E1-024 | Ad5 | E1A Δ2-36, 55K H260A | E1-005 | Original | del res 2-36 in E1A (p21 binding, PDZ domain), E1B-55K H260A (CAC->GCC) | |
| E1-025 | Ad5/9 | Ad5 with Ad9 pIX | E1-019 | Original | pIX from Ad9 was SLIC'd into PacI-cut E1-019 | |
| E1-026 | Ad5/12 | Ad5 with Ad12 pIX | E1-019 | Original | pIX from Ad12 was SLIC'd into PacI-cut E1-019 | |
| E1-027 | Ad5 | None | E1-001 | version 3 | attB4 site moved into the 3'UTR of E1B/pIX | |
| E1-028 | Ad5 | None | E1-001 | version 4 | attB4 site moved directly in front of pIX start codon. | |
| E1-029 | Ad5 | ΔE1A/E1B + EF1α-(luciferase-eGFP fusion)-miR122 | E1-015 | version 3 | adsembly version3 of E1-015 | |
| E1-030 | Ad5 | E1A ΔLXCXE, ΔE1B-55K | E1-021 | Original | mutations of E1-012 combined with E1-021 | |
| E1-031 | Ad5 | GFP-E1A | E1-001 | Original | GFP inserted in frame before start codon of E1A. Based on Zhao et al. JBC 2006. | |
| E1-032 | Ad5 | ΔE1A/E1B + CMV-eGFP; ΔpIX + PacI | E1-009 | Original | pIX deleted and replaced by a PacI site. Cut with PacI and SLIC in other pIX genes. | |
| E1-033 | Ad5/MAV1 | ΔE1A/E1B + CMV-eGFP; with MAV-1 pIX | E1-032 | Original | pIX from MAV-1 was SLIC'd into PacI-cut E1-032 | |
| E1-034 | Ad5 | pIX-FLAG-eGFP | E1-001 | Original | linker w/FLAG-eGFP sequence SLIC'd at C-term of pIX | |
| E1-035 | Ad5 | ΔE1B-19K | E1-001 | Original | start codon of E1B-19K to start codon of E1B-55k deleted | |
| E1-036 | Ad5 | ΔE1B-19k, ΔE1B-55k | E1-001 | Original | start codon of E1B-19K to stop codon of E1B-55k deleted | cloning in process . . . (May 31, 2011) |
| E1-037 | Ad5 | E1A Δ2-36, ΔE1B-55k | E1-012 | Original | combined E1-012 and E1-022 mutations | |
| E1-038 | Ad5 | ΔE1A/E1B | E1-006 | version 3 | Lacks bp 448-3513 of the Ad5 genome. Replaced with PacI-PmeI-AscI SLIC MCS. | |
| E1-039 | Ad5/3 | Ad5 with Ad3 pIX | E1-019 | Original | pIX from Ad3 was SLIC'd into PacI-cut E1-019 | |
| E1-040 | Ad5/34 | Ad5 with Ad34 pIX | E1-019 | Original | pIX from Ad34 was SLIC'd into PacI-cut E1-019 | |
| E1-041 | Ad5/9 | Ad5 with Ad9 pIX; E1A ΔLXCXE | E1-025 | Original | deleted LXCXE in E1A from E1-025 using single primer | |
| E1-042 | Ad5/11 | Ad5 with Ad11 pIX; E1A ΔLXCXE | E1-023 | Original | deleted LXCXE in E1A from E1-023 using single primer | |
| E1-043 | Ad5 | GFP-E1A ΔLXCXE | E1-021 | Original | Same N-terminal fusion of GFP to E1A as E1-031 | |
| E1-044 | Ad5 | ΔE1A/E1B + EF1α-(luciferase-eGFP fusion) | E1-014 | version 3 | adsembly version3 of E1-014 | |

TABLE 3

VIRUSES AdSLIC Macromodules

| ID | Serotype | Mutations | Parental E3 | Adsembly version | Comments | Plasmid Map |
|---|---|---|---|---|---|---|
| E3-001 | Ad5 | None | | Original | Wild-type E3-fiber region from Ad5 viral DNA | |
| E3-003 | Ad5 | PmeI-flanked Ad5 fiber | 001 | Original | Adds PmeI sites directly flanking the Fiber coding region in order to make swaps with other serotypes. | |
| E3-004 | Ad5/34 | Ad34 fiber | 003 | Original | Ad34 Fiber was SLIC'd into PmeI-cut "PmeI-flanked Ad5 fiber" vector. | |
| E3-008 | Ad5 | Δfiber shaft/knob | 001 | Original | Lacks the fiber shaft and knob. Cut with PacI to SLIC in alternate shaft/knobs. | |
| E3-009 | Ad5/3 | Fiber chimera: Ad5 tail, Ad3 shaft/knob | 008 | Original | Ad3 fiber shaft knob obtained from viral DNA and SLIC'd into PacI-cut clone E3-008 | |

TABLE 3-continued

VIRUSES AdSLIC Macromodules

| ID | Serotype | Mutations | Parental E3 | Adsembly version | Comments | Plasmid Map |
|---|---|---|---|---|---|---|
| E3-010 | Ad5/9 | Fiber chimera: Ad5 tail, Ad9 shaft/knob | 008 | Original | Ad9 fiber shaft knob obtained from viral DNA and SLIC'd into PacI-cut clone E3-008 | |
| E3-011 | Ad5/12 | Fiber chimera: Ad5 tail, Ad12 shaft/knob | 008 | Original | Ad12 fiber shaft knob obtained from viral DNA and SLIC'd into PacI-cut clone E3-008 | |
| E3-012 | Ad5 | ΔUexon-Fiber | 001 | Original | Lacks the U-exon and Fiber. Cut with PacI to SLIC in alternate Uexons/Fibers. | |
| E3-024 | Ad5 | ΔADP + mCherry | E3-001 | Original | ORF of ADP replaced with mCherry | |
| E3-025 | Ad5 | ΔADP + mCherry-ADP | E3-001 | Original | ORF of ADP replaced with mCherry-ADP fusion | |
| E3-026 | Ad5/11 | Contains the Ad11 Uexon and Fiber. All else is Ad5. | E3-012 | Original | The Ad11 Uexon and Fiber were SLIC'd into PacI-cut E3-012. | |
| E3-028 | Ad5 | Δfiber knob | E3-001 | Original | Lacks the fiber knob. Cut with PacI to SLIC in alternate knobs. | |
| E3-029 | Ad5/3 | Fiber chimera: Ad5 tail/shaft, Ad3 knob | E3-028 | Original | Ad3 fiber knob obtained from Ad3 viral DNA. | |
| E3-030 | Ad5/9 | Fiber chimera: Ad5 tail/shaft, Ad9 knob | E3-028 | Original | Ad9 fiber knob obtained from pAd9-SE. | |
| E3-031 | Ad5/11 | Fiber chimera: Ad5 tail/shaft, Ad11 knob | E3-028 | Original | Ad11 fiber knob obtained from Ad11 viral DNA. | |
| E3-032 | Ad5/12 | Fiber chimera: Ad5 tail/shaft, Ad12 knob | E3-028 | Original | Ad12 fiber knob obtained from pAd12-SE. | |
| E3-033 | Ad5/34 | Fiber chimera: Ad5 tail/shaft, Ad34 knob | E3-028 | Original | Ad34 fiber knob obtained from Ad34 viral DNA. | |
| E3-034 | Ad5/9 | Contains the Ad9 Uexon and Fiber. All else is Ad5. | E3-012 | Original | The Ad9 Uexon and Fiber were SLIC'd into PacI-cut E3-012. | |
| E3-035 | Ad5/12 | Contains the Ad12 Uexon and Fiber. All else is Ad5. | E3-012 | Original | The Ad12 Uexon and Fiber were SLIC'd into PacI-cut E3-012. | |
| E3-036 | Ad5 | None | E3-001 | version 3 | The attB3 site moved into the 3'UTR for E4. The attB 5 location is unchanged. | |
| E3-037 | Ad5/3 | Fiber chimera: Ad5 tail/shaft, Ad3 knob | E3-029 | version 3 | adsembly version 3 | |
| E3-038 | Ad5/9 | Fiber chimera: Ad5 tail/shaft, Ad9 knob | E3-030 | version 3 | adsembly version 3 | |
| E3-039 | Ad5/11 | Fiber chimera: Ad5 tail/shaft, Ad11 knob | E3-031 | version 3 | adsembly version 3 | |
| E3-040 | Ad5/12 | Fiber chimera: Ad5 tail/shaft, Ad12 knob | E3-032 | version 3 | adsembly version 3 | |
| E3-041 | Ad5/34 | Fiber chimera: Ad5 tail/shaft, Ad34 knob | E3-033 | version 3 | adsembly version 3 | |
| E3-042 | Ad5 | ΔE3-12.5K + mCherry | E3-001 | Original | | |
| E3-045 | Ad5/3 | Contains the Ad3 Uexon and Fiber. All else is Ad5. | E3-012 | Original | The Ad3 Uexon and Fiber were SLIC'd into PacI-cut E3-012. | |
| E3-046 | Ad5/34 | Contains the Ad34 Uexon and Fiber. All else is Ad5. | E3-012 | Original | The Ad34 Uexon and Fiber were SLIC'd into PacI-cut E3-012. | |

TABLE 4

VIRUSES AdSLIC Macromodules

| ID | Serotype | Mutations | Parental E4 | Adsembly version | Comments | Plasmid Map |
|---|---|---|---|---|---|---|
| E4-001 | Ad5 | None | | Original | Wild-type E4 region obtained from pAd/CMV/V5-DEST | |
| E4-002 | Ad34 | None | | Original | WT E4 region obtained from Ad34 viral DNA | |
| E4-003 | Ad5 | None | | Original | Contains PacI next to ITR rather than I-SceI | |
| E4-004 | Ad34 | None | | Original | Contains PacI next to ITR rather than I-SceI | |
| E4-005 | Ad5 | E4orf3 I104R | E4-001 | Original | Made by quikchange. ATA -> CGT | |
| E4-006 | Ad5 | ΔE4orf3 | E4-001' | Original | E4-ORF3 is deleted and BAMH1 and XhoI sites are inserted | |
| E4-011 | Ad5 | E4orf3-N82A | E4-001 | Original | E4-ORF3 is replaced by E4-ORF3 mutant | |
| E4-012 | Ad5 | E4orf3-E10K/E52K/E53K/H55K | E4-001 | Original | E4-ORF3 is replaced by E4-ORF3 mutant | |
| E4-013 | Ad5 | ΔE4orf1 | E4-001 | Original | E4ORF1 deleted, E4ORF2 start codon shifted to original position of E4ORF1 | |
| E4-014 | Ad5 | ΔE4orf4 | E4-001 | Original | E4ORF4 deleted, E4ORF5 start codon shifted to original position of E4ORF4 | |
| E4-015 | Ad5 + Ad9 | E4orf3 Ad9 | E4-001 | Original | E4-ORF3 from Ad9 replaces the E4-ORF3 from Ad5 | |
| E4-016 | Ad5 + Ad12 | E4orf3 Ad12 | E4-001 | Original | E4-ORF3 from Ad12 replaces the E4-ORF3 from Ad5 | |
| E4-017 | Ad5 + Ad34 | E4orf3 Ad34 | E4-001 | Original | E4-ORF3 from Ad34 replaces the E4-ORF3 from Ad5 | |

TABLE 4-continued

VIRUSES AdSLIC Macromodules

| ID | Serotype | Mutations | Parental E4 | Adsembly version | Comments | Plasmid Map |
|---|---|---|---|---|---|---|
| E4-018 | Ad5 | None | E4-001 | version 3 | attB3 site moved into the 3'UTR of E4. | |
| E4-019 | Ad5 | ΔE4orf6/7 | E4-001 | Original | sequence downstream of E4orf6 encoding E4orf6/7 deleted, retaining E4orf6 | |

TABLE 5

Go Back To: VIRUSES AdSLIC Macromodules

| ID | Serotype | Mutations | Parental E2-L2 | Comments |
|---|---|---|---|---|
| E2-001 | Ad5 | none | | WT Ad5 E2-L2 PCR'd from plasmid pAd/CMV/V5-DEST |

TABLE 6

Go Back To: VIRUSES AdSLIC Macromodules

| ID | Serotype | Mutations | Parental L3-L4 | Comments |
|---|---|---|---|---|
| L3-001 | Ad5 | none | | WT Ad5 L3-L4 region PCR'd from plasmid pAd/CMV/V5-DEST |

TABLE 7

Go Back To: VIRUSES AdSLIC Macromodules

| ID | Serotype | Mutations | E2-L2 used | L3-L4 used | Available as DEST for Assembly | Adsembly version | Comments | Plasmid Map |
|---|---|---|---|---|---|---|---|---|
| core-001 | Ad5 | none | 001 | 001 | Yes | original | pUV3 build. No attB6 site linker. | |
| core-002 | Ad5 | none | 001 | 001 | Yes | original | pUV12 build. Contains an attB6 site linking the E2-L2 and L3-L4 modules. | |
| core-003 | Ad5 | hexon E451Q | 001 | 002 | Yes | original | | |
| core-004 | Ad11 | none | | | No | original | Contains Ad11 (GenBank BK001453) 3951-27184bp. Which is E2B-pVIII. Flanked by SwaI and FseI. Not sequenced. | |
| core-005 | Ad9 | none | | | No | original | Contains Ad9 (GenBank NC_010956) 3862-26183bp. This is E2B-pVIII. Flanked by PmeI and PacI. Not sequenced. | |
| core-006 | Ad12 | none | | | No | original | Contains Ad12 (GenBank NC_001460) 3820-26313bp. This is E2B-pVIII. Flanked by SwaI and FseI. Not sequenced. | |
| core-007 | Ad5 | none | | | Yes | version 3 | Sequence added to the 5' end by primer annealing to make compatible with the version 3 E1 entry vector. | |
| core-008 | Ad5 | none | | | Yes | version 4 | Sequence added to the 5' end by SLIC to make compatible with the version 4 E1 entry vector. | |
| core-009 | Ad5 | hexon E451Q | | | Yes | version 3 | adsembly version 3 of core 003 | |
| core-011 | Ad3 | none | | | No | original | Contains Ad3 (GenBank DQ086466) 3938-27403bp. Flanked by SwaI and PmeI. Not sequenced. | |
| core-012 | Ad34 | none | | | No | original | Contains Ad34 (GenBank AY737797) 3953-27185bp. This is E2B-pVIII. Flanked by SwaI and PmeI. Not sequenced. | |

TABLE 8

Go Back To: VIRUSES

| ID | Serotype | Regions | Mutations | E1 used | E2-L2 used | L3-L4 used | E3 used | E4 used | Comments | Plasmid Map |
|---|---|---|---|---|---|---|---|---|---|---|
| ASMM-001 | Ad5 | E2-E4 | none | | 001 | 001 | 001 | 001 | PacI for E1 insertions | |
| ASMM-002 | Ad5 | E1-L4 | none | 001 | 001 | 001 | | | SwaI for E3 + E4 insertions | |
| ASMM-003 | Ad5 | E1-E3 | none | 001 | 001 | 001 | | | SwaI for E4 insertions | |
| ASMM-004 | Ad5 | E2-E4 | E4orf3-I104R | | 001 | 001 | 001 | 005 | PacI for E1 insertions | |
| ASMM-005 | Ad5 | E1-L4 | ΔE1B-55K | 012 | 001 | 001 | | | SwaI for E3 + E4 insertions | |
| ASMM-006 | Ad5 | E1-E3 | ΔE1B-55K | 012 | 001 | 001 | 001 | | SwaI for E4 insertions | |
| ASMM-007 | Ad5 | E2-E4 | ΔE4ORF3 | | 001 | 001 | 001 | 006 | E4ORF3 is deleted in E4 entry vector | |
| ASMM-008 | Ad5 | E1-L4 | E1A ΔLXCXE | E1-021 | | | | | Used core-001, E1A has LXCXE deletion in CR region | |

TABLE 8-continued

Go Back To: VIRUSES

| ID | Serotype | Regions | Mutations | E1 used | E2-L2 used | L3-L4 used | E3 used | E4 used | Comments | Plasmid Map |
|---|---|---|---|---|---|---|---|---|---|---|
| ASMM-009 | Ad5 | E1-L4 | GFP-E1A | E1-031 | | | | | Used core-001, GFP inserted in frame before start codon of E1A. Based on Zhao et al. JBC 2006. | |
| ASMM-010 | Ad5 | E1-L4 | pIX-FLAG-GFP | E1-034 | | | | | Used core-001, linker w/FLAG-eGFP sequence SLIC'd at C-term of pIX | |
| ASMM-011 | Ad5 | E2-E4 | hexon E451Q | | E2-001 | L3-002 | E3-001 | E4-001 | PacI for E1 insertions | |
| ASMM-013 | Ad5/11 | E2-E4 | none | | | | E3-026 | E4-001 | Used core-004. | |
| ASMM-014 | Ad5/9 | E2-E4 | none | | | | E3-034 | E4-001 | Used core-005. | |
| ASMM-015 | Ad5/12 | E2-E4 | none | | | | E3-035 | E4-001 | Used core-006. | |
| ASMM-016 | Ad5/3 | E2-E4 | none | | | | E3-045 | E4-001 | Used core-011. | |
| ASMM-017 | Ad5/34 | E2-E4 | none | | | | E3-046 | E4-001 | Used core-012. | |
| ASMM-018 | Ad5 | E1-L4 | GFP-E1A ΔLXCXE | E1-043 | | | | | Used core-001 | |

TABLE 9

Go Back To: VIRUSES

| ID | Serotype | Regions | Mutations | E1 used | E3 used | E4 used | core used | Comments |
|---|---|---|---|---|---|---|---|---|
| AA-DEST-001 | Ad5 | E1-E4 | CMV-attR1-Cm-attR2 | | | | | E1 replaced by CMV attR1-Cm-attR2 from pAd/CMV/V5 Dest vector |
| AA-DEST-002 | Ad5 | E1-E4 | CMV Myc epitope-attR1-Cm-attR2 | | | | | E1 replaced by CMV Myc epitope-attR1-Cm-attR2 from pAd/CMV/V5 Dest vector |
| AA-DEST-003 | Ad5 | E1-E4 | CMV Flag epitope-attR1-Cm-attR2 | | | | | E1 replaced by CMV Flag epitope-attR1-Cm-attR2 from pAd/CMV/V5 Dest vector |

SEQUENCE LISTING (195 sequences)

SEQ ID NO: 1 - protein, 1149 aa, Canine adenovirus 1
MSLVQSHGTSGLFTEPPNSINQQESSGPSLPAQDATQASASSARAGATPAINSTKRKYRGAVVAQRATLSISAILDNGQCVQIKYHSNLASALTNLCNTNLYDLPACLNKPITVHNLPTLIEEAAASYSLIYYYQRGTVRKVEFRAEIPLLSFPLKFLVKHGKVFLIKDISPMQRCEFCGSFFKVTHTCTLRRRDFYFHHVASHSGDWWEKISFSPIGAPANTERLFIVYDVETYTWHGKFGKQLVPFMLVFQLLGDEHLVNAAKNLATTQNWDTWNSNEQTALYYCITPEKRAIGVKFKTFRDTLQQHFANNLWSHVLCQNPKLMEEAAALGLENPEDITANQLKKFKLQGTPRFIEVYVVGHNITGFDEILLAAQVVSTRAEIPPVFDISRNFMPRAGRLLFNDITYSLPNPSYVPSKDYRHWEQGQVLASDLKTQYIKFMVRDTFSLTHTSLKNAAKAYSLTVSKGCCPYQAVNEFYMLGSYQQDADGFPDLKYWKDQEEYCFNKDLWKKEKKGAYDIIQQTLDYCALDVQVTAQLVNKLIESYQIFIKNSVNLPETYFNVFQRPTISSNSHAIFKQILYRAEKPNAPHLNTIIMAPSNEMYEYVRLSIRGGRCYPTYIGVLQEPVFVYDICGMYASALTHPFPAGSPLNPYERAVAIKAYEHKMQEHKTISYFDEDLLPGIFTIDADPPAEEFLDVLPPFCSRKGGRLCWTNEPLRGEVTTSIDVITLHNRGWKVTLIPDTRTTVFPEWKCLAREYVQLNINAKEKADKSKNQTMRSIAKLLSNALYGSFATKLDNKKTVFSDQIESNIAKEIASGAYVVKSSSYIETDNLCAEIMPEFVVAYPPVNFDVHRLAPPSYSEEYPTENPHAEGPFMQNFNMTSYRYKPIMFIDAEDDDFCLHTLEKSTPLITNNRYASQIASFVLAWTRAFVSEWSQFLYENDAGIPLEKRILKSVYGDTDSLFTTMEGYRLMEEKGKRRLKKNGGNLVFDPNNPELTWLVECETKCEKCGADAYSSESVYLAPKLYALKDTTCPECQYVGKGKLRAKGHATSTLSYDVLKACYYADLQQGSDIFKTSRMSLRRTLTSVQTHVQPFTVTETTLTRKLRPWKDKTLHALDMNRLIPYSRKYPNPRNNETTWMELQWMT

SEQ ID NO: 2 - protein, 1150 aa, Canine adenovirus 2
MSLVQGHGTSGLFTEPPNPINQQESSGPSLPAQDAAQAFASSPRAGATSTIVNPPKRKYKGAVVVQRATLSISAVLDNGQCVEIKYHSNLASALTNLCNTNLYDLPACLNRPITAHNLPALIEEAAAPYSLICYYQRGTVRRVEFQAEVPLLSFPLKFLVKQGKVFLIKDISQMQKCEFCGSFFKVTHTCALRRRDFYFHHVAAHSADWWEKISFTPIGAPPNTERLFIVYDVETYTWHGKFGKQLVPFMLVFQLLGDDHLVNVAKTLATEQNWEIWNGKEQDTLYYCITPEKRAIGVKFKKFRDTLQQHIAASLWSHVICQNPQLQEKATTLGLESPEELTPDQLKKFKLKGNPRFIEVYAVGHNITGFDEILLAAQVVSTRAEIPPVFEICRNFMPRAGRLLFNDITYSLPNPSYVPAKSYEHWEQGQVLASDLKSQYIKFMVRDTFSLTHTSLKNAAKAYSLTVSKGCCPYQAVNEFYMLGSYQQDADGFPDLKYWKDQEEYSFNKDLWIKEKKGAYDIIQQTLDYCALDVQVTAQLVNKLIESYQIFIKNSVNLPETSFNVFQRPTISSNSHAIFKQILYKAEKPNTHHLSTILMAPSNEMYEYVRLSIRGGRCYPTYIGVLQEPVFVYDICGMYASALTHPFPAGSPLNPYERALAIKAYEQKMLNHKTISYFDKDLLPGIFTIDADPPAEEFLDVLPPFCSRKGGRLCWTNEPLRGEIATSIDVITLHNRGWKVTLIPDTRTTVFPEWKCLAREYVQLNISAKEEADKSKNQTMRSIAKLLSNALYGSFATKLDNKKTVFSDQIESNIAKEIASGAYVVKSSSYIETDNLCAEIMPEFVVAYPPVNSDVRQLAPPSCSEEDPTKDPLAEAPFMHNFSMTSYHYKPIMFIDAEDDDFCLHTLEKSTPLIANNRYPSQIASFVLAWTRAFVSEWSQFLYENDAGTPLENRVLKSVYGDTDSLFTTMEGYKLMEEKGKKRLKKNGGKLVFDPSNPELTWLVECETQCEKCGSDAYSSESVYLAPKLYALKDTTCPKCHHVGKGKLRAKGHATSTLSYDVLKACYYADMQQGSDVFKTSRMSLRRTLTSVQAHVQPFTVTETTLTRKLRPWKDKTLHALDMHRLIPYSRKHPNPRNTETTWMELQWMT

SEQ ID NO: 3 - protein, 1135 aa, Bat adenovirus PPV1
VQGDRTRGILPKQTDSNYQPKGSSASLSAEIQSQTTPGTPRPSTASSLKTPRRKYKGAVVAQRATLSISAMLDDGQPAEIKFHSNLLTALTALCNTNLHDLPECFLAPITAPNLPALIEQAAAPYSLICYYNRGSVRRVQFQAESPLLSFPLKFLVKHNKVFLIKDISPVNKCEFCGSFFKVTHTCSLRRRDFYYHHVAAHSSDWWEKIAFAPIGSPAETERLFIVYDIETYTWHGKFGKQLVPFMLVFQLHGDAHLVAAATALARELGWDRWQDKEDVFCIVTPEKRVIGIKFKQFRDRLQQCLANSLWSHFLVANPQIQEEATNRGLACPEDLFPEDLRKIKVKGVPRFIEVYAVGHNITGFDEILLAAQVVSTKAEIPSVFEISRNFMPRAGRLLFNDVTYSLPNPAWVPTKTFEHWEAGQLSACDLKNQFLKFMVRDTFTLTHTSLRNAAKAYSLPVAKGCCPYQAVNDFYMLGTYQQDEQGFPAVEYWKDREEYLLNKALWLDKKTGAYDIVQQTLDYCALDVQVTAQLVQKLIASYQEFIATSVNLPAASFNVFQRPTISSNSHAIFKQILYRAEQPGQGHFNTILLAPSNEMYEYVRASIRGGRCYPTYIGVLAEPVFVYDICGMYASALTHPFPAGAPLNPYERALAMRAYELKMQQCPQISYFDAELLPAIFTIDADPPEDSHLDVLPPFCSRKGGRLCWTNEPLRGEIATSIDVITLHNRGWKVTLVPDARATVFPEWKCIAREYVQLNINAKEKADKDKNQTMRSIAKLLSNALYGSFATKLDNKKTVFSDQIEHNLAKEIAAGEFVVKSSSYIETDNLCAEIMPEFVVAYPPADTPSSEVDASPLSEDPEETPFIGNDRMTSYTYKPITFLDAEDDSFCLQTLERASPLIANNRYPSQIASFVLAWTRAFVSEWSQFLYADDVGIPLEDRQLKSVYGDTDSLFTTLEGYKLMETKGKHRLKKNGGKLVFDPSNPELTWLVECETQCEKCGSDAYSSESVYLAPKLYALKDTTCVSCGHVGKGKLRAKGHATSSLSYDVLKACYLADMQHGSDVFHTSRMSLRRTLTSVQSHVQPFTVTETTLKRRLRPWKDKTLHPLDANRLVPYSRRFPNPRNTETTWMEWQ

SEQ ID NO: 4 - protein, 1142 aa, Bat adenovirus TJM
MALVQNDGARRLFPEQPNSDHQPPGHSPGEPAQIPAPSPAGAPLPGAAAPVKPQRRQYKGAVVTQRATLSVSAVLDDGQFVEIKYHADWKAALASLCHANLCEVPACFENPLTPYSLLTLLEQAAAAHSLICYYQRGKVRRVQMQAAQPLLHFPLQFLVKQAKFTSLKTLPPPTSASSVVLSTRSPTPAPSGAETFTSTTLPPTPPTGGKRQPSPLWDLPRKPKGCLLSMTSRPTPGTGALASNWYPSCQSSSWWARPPWWPRPGSWPRPRDGTPGTLREMSFTASPLRKKPSVSSLRSSGTRCSSCWPPSSGSHFLSQNPDLEAKTRELGLPNSEDISYAALKKLKLQGAPRFIEVYVVGHNITGFDEILLAAQVVSTRAEIPPAFQISRNFMPRAGRLLFNDVTYALPNPAYFPRKDYTDWEKGQLLACDLRNQFIKFMVRDTFTLTHTSLRNAAKAYNLPVSKGCCPYQAVNEFYMLGTYRRDADGFPAEDYWKDAEEYRFNKQLWREEKKDAYDIIQSTLDYCAQDVKVTTQLVLKLTEAYQAFVAESVNLPEASFNVFQRPTISSNSHALFKQILFRAEKPNQSHLGTTLLAPSNEMYEYVRASIRGGRCYPTFIGLLDEPVFVYDICGMYASALTHPFPAGPPLNPFERALAVRRYELKMQTEAQISYFDPELLPAILTIDADPPADEFLDVLPPFCSRKGGRLCWTNEPLRGEVATSIDVITLHNRGWKVRFVPDARATVFPEWKCLAREYVQLNIQAKEQADKNKNQTMRSIAKLLSNALYGSFATKLDNKKTVFSDQIDAETAHDISTGAFVVKSSSYIETDNLCAEIMPEFVVAYPPDPSVALTHTAVANDGDPHPETPFMSPTSVTSYTYKPITFLDAEDDDFCLHTLEKSTPLIANNRYPSQIASFVLAWTRAFVSEWAQFLYADDAGIPLEKRNLKSVYGDTDSLFTTREGYRLMEEKGKKRLKKNGGKLVFDPDHPELTWLVECETQCEKCGGDAYSTESVYLAPKLYALKNTVCTRCGHVGKGKLRAKGHATSELSYDTLKACYLADLQQGSDVFQTSRTSLRRTLASVQAHVQPFTVTETTLTRKLRPWKDKTLHEVDSHRLIPYSRRFPNPRNTETTWMELPWTS

SEQ ID NO: 5 - protein, 1112 aa, Turkey adenovirus 3
MSKYIYTTQNEIPYRLQICKKDIKATIIEIAWTYNLFNCKKLAKKVKDAQSYILICSKYKPTNSDIENVKNLPVKSITIWKKLTGCVMIQNEFKTSHEYIELDFIYDKSKLCWIKSWTQQQKCSSCGRIYSAIHTCNDLRSTYYYNSVDNDTRKFWETIPFQPIGENENTKKLFLIYDIETFTLAETSGVLLNPLLLCFSIFGDDCLINICKTEIAKIKSIQTKNSTYFWFSKVKNFISTEFRKLRNNILFALTDYFTKLILTPENREILEDFAQTQNLESITNINLSEHTNLIMSLKVKPIFIEFYIIGHNIQSFDEILLATQILQDENLDITPLFTVERNFMPRQGRILFNDITIKFPNPDYYVAKEEKKNNKSEILSQIKEGIPHPESIKNLYIKSMVRDTFQITHTSLKEAAKAYNLKIHKGCCPFKAINEYMSTNSLSTDSDSFPSEKYWSSKEEYNEQKEIWLEKKEVKYDIVKELIDYCIKDVKITEELTKTLLNTFDTFIKEELNLKCNFNIFKRPTISSNSHAIFRQLHFKQNGTKASTLPDIVAPSDEMYSFIRQSVRGGRCYPTHLGIFKEKIFVYDICGMYASALTHPMPYGFPIGEKERNNEITKLNEKLKKTKTKLSYFTDIKPMVVMIDAIPPPPEHLDPLPPLCSRQSGKLCWTNEILKNEIVTSIDIITLHNRGWKVNIIPHKLNTVFPTWNTCCLEYVTKNILAKEKATVEKNPVKRAISKLLSNALYGSFATRESNDITIFENHIQENPKIRNQLLNKQLTIDSITTLPTYNLPYVSIENLTFTLKNRTDSAERNLELDDELTSPFNSLEFMDESPASQTSTSTAHVGTYKPFNILDVTSENLTIYMLKSTNLHPTNKRYPTQLASFVLAWTRAFMSEWREILYSDEDSIPVQFKTIKSIYGDTDSLFLTEKGHQNMLKYGQHRIKNKNSQLTFDPKKPSIVWAVECETWCNLCNSPAYSSKSIFLAPKLYALKEITCTTCKNSKTGKLRAKGHCTADITFEILEECFNYHTSELKSGEIFQTERTALKRTLCKSYGKFSPFSVHEIQLIRELRPWNDPTLYFLKTNTLIPYDLYHPNPRITNPILLQEFEDE

SEQ ID NO: 6 - protein, 1112 aa, turkey adenovirus A; identical to SEQ ID NO: 5

SEQ ID NO: 7 - protein, 1108 aa, Great tit adenovirus
MSYMYVTQNETPYRLSISKKSIKETLLEICWNFNFFHCKKICKKLKQCESYILVCCKFKEQNTAIENIKQLPAQKITIWKKLTGCIVIQQEITNSTASSIQLDFVQTKDGLKWIKTWTKQQKCTSCGRIYVTSHTCDYNRSSFYYNQIASSKKYWESIQFQPIGETENTFKLFLVYDIETYTLAESEGINLQPCLLCFTIFGEQELTKIAMEEINRDRTITHSNDNIFYWHSKTKNFISQQFRLLRENILNRMIQVLTTHILSKENKEVLDDFIKLKKLQTYKDIDISKEKNLLLSLTIKPIFLEFYVVGHNIQSFDEILLATQILQPNKFQYEPFLTISRNFMPRQGKILFNDITITFPNPEYHIADEGKENKTAEIIADAREGKPNVKNIKHLYVKSMVRDTFQITHSSLKTAAEAYNLPTSKGCCPFKAINDFYSLGSYRGESETNFPVVTYWSCEDEYKEQLEIWKQKQEKNYDIVKELIEYCCRDVLVTVSLTKCLLETFNSFVTHEFNLNCTFNIFKRPTISSNSHAIFRQIHYKEYGNKLNQLPDIYAPSEEMYEFIRKSVRGGRCYPTFLGRFAEKLYVYDICGMYASALTHPLPYGTPVGKEERDHEIKKFNQLLSSKDEISYFADIKPMIVCINAFPPPPELLDPLPPLCSKASGKLCWTNEPLHKEIVTSIDIITLHNRRWSVSILQHPLNTVFSSWKTCCSNYVKANIQAKEKASKEKNPVKRAISKLLSNALYGSFATKEDNDMVIFEQSLTDKIKHQISQNELQITNITSIPTEQLPSTCYTNIQYFLKSKLPDHRANQQADDELTSPFEAVPEEQPEPSFCSTQTHMTTYKPFNILDVTSDNLTIYMLKSTKPHPTNKRYPTQLASFVLAWTRAFISEWAEILYHDENNIPIENKSLKAIYGDTDSLFLTEAGHRLMLSKGNYRLKSDKTPLIFNPEAPKLTWAVECETECNVCKKPGFCPDSIFLAPKLYALKKIFCPSCNTEFGGKLRAKGHATTHLTFEILLECFNCHKTCSGPARKFTTERRALKRTIHKPYGQFSPFTIHEINLIRELRPWHDPTLVFITDKVLIPYDLQHRNPRVTAPILIEEFEDE

SEQ ID NO: 8 - protein, 1108 aa, frog adenovirus 1
MSAFGSIENDHFRLKLNSKPAKLAILDICWQFNLFNCKKFKHKKHIASLIYSQCSYNSNKSLYELCKTLPIKTLQLWKIQKGSIIRTQKLDLDQGEIIIDLLSPKHLWIVEWFEQNKCKNCGRFFSYNHVCNTNRASYYYHKIANTKTQWETINFSPIGEPKGTKKLFLVYDIETYTKACPVGYKLCPVLLCFTIFGDETLNKEVHELISSNSNILELNNLGECFYWLSKETNYISSKFRKTRLLIQNFLIEKMIKNFLTEENKEILTDYAKAHNYESIYEIDLLKDKNLILTLQAPFINLEFYVIGHNISSFDEILLAHQILQKDTTTIPQPFIQIKRNFLPRQGKILFNDITFSLPYPEYYVHEEENTLTKKEAIEIEKTGEPSLFRTKEICVKTMVRDTYQLTHCSLRLAAEAYGLKTTKGNCPFKAVTEFYSVNSFDKDKFGFPAPKYWTDNEEYMTQLKIWQQNDEPYDLQKELIKYCAQDVNVTKNLTISILNSYNEFIKENFKLTCNYNVFKRPTIPSNSQAIFKQLLYKKHGKKFGKMPDIMAPSAEMYEFVRESVRGGRCYPSLLGEIKEPIYVYDICGMYASALTHPMPFGVPLSQKEKNQEIHILQSKLQNEKTLNYFDPEIKPMIISISAFPPPVEYLTNIPPICSRKSGRLCWTNEALYDETVTIVDVITLHNCGWKVKIEDHPLNTVFPNWNTCCKEYVEVNIAAKEKADKDKNQIMRSISKLLSNSLYGSFATKEDNSMIVFEHMLKSNHIKTKLEQNEIKIDAVFGIPTNGIEHTTIDNKLFYLSNTNTLNDSNAPPIDDELLTPFSEEAYAEEEVEQLAPENSNCHVRTYQPFTLIDVDTEDLTLYSLKSNKKFTENKRYPTQLASFVLSWTRAFMADWNAILYEKDSKSILVKELNAIYGDTDSLFLTEKGHKRMIDHGQHRLKENVKSLVFQECCPDITWAVECETKCPNCKSSAFSNRTIFLAPKLYALKRIVCNSCNTETEGKLRAKGHAKNDMTFELLCTCFEYHKNCHTKGKRFSTERTALKRTLYKPYGKFEPFTIHQVRLIRELRPWHDPTMLERDDGFLIPYYVGHPNPRDKRVKYLEDIDG

SEQ ID NO: 9 - protein, 1255 aa, fowl adenovirus 1
MEADAGPPLTDSVLGPDSHVIRTISAKRLEETRKYFKSFRGNPLRTNVYYIEEQPFRFQPTVFPIGLKKFLRTHRFLLSKRARGYDRIDYLHYARDPERSLPDFKPAQVTVIDFKGKTARLRTVHISEHPALPPMLIAKNVTGEWVWITSRTPVQQCPTCGRHWVRRHSCNERRSAFYYHAVQGSGSDLWQHVHFSCPAQHPHIRQLYITYDIETYTVFEKKGKRMHPFMLCFMLSGDPQLVSRAERLARQDDRLKALDEGFYWLDSHPGEVARRFRNFRSRLQIEFAQNLVDRYAAANRDYCDQLVKDGKYGSVHKIPYELFEKPTSPLSLPDNFYSVDIVVLGHNICKFDELLLATELVERRDLFPEACKCDRSFMPRVGRLLFNDIIFRMPNPNYVKKDASRVERWSRGIVSQQDARSVFVRFMVRDTLQLTSGAKLSKAAAAYALDLCKGQCPYEAINEFISTGRFHADADGFPVERYWEDPSVIAEQKNLWQKEHPGQQYDIVQACLEYCMQDVRVTQKLAHTLHDSYDAYFQRELGMEGHFNIFVRPTIPSNTHAFWKQLTFSNYVREQRATCPPSVPEPHKKKGRTKKKKQPSPDYVAEVYAPHRPMFKYIRQALRGGRCYPNVLGPYLKPVYVFDICGMYASALTHPMPHGMPLDPKFTAQHVGELNRLLTNESHLSYFDARIKPSILKIEAYPPPPEMLDPLPPICSRRGGRLVWTNEALYDEVVTVIDILTLHNRGWRVQVLHDEMNIVFPEWKTLCADYVTKNILAKEKADREKNEVIRSISKMLSNALYGAFATNMDTTRIIFEQDLSEADKKNIYEGTEIVKHVTLLNDDSFNGTEVTLESAPNPFSEESLRQQFRYADDPEQEEPEAEEDEEEEGDDSDRESARKPKNALTEDDPLVAVDLEVEATLATGPYIPEGELSSAHYARANETRFKPMRLLEATPEALTVLHLENLDKQVANKRYATQIACFVLGWSRAFFSEWCDILYGPDRGVHILRREEPRSLYGDTDSLFVTETGYHRMKSRGAHRIKTESTRLTFDPENPGLYWACDCDIKCKACGSDTYSSETIFLAPKLYGLKNSICVNEQCRTVGPGKIRSKGHRQSELIYDTLLRCWRRHEDVQFGAQSNIPELHTRRTIFKTTLLNKVSRYDPFTIHNEQLTRVLRPWKDLTLYEHGDYLYPYDNEHPNPRTAGDVRPVPIVGHEDPLAPLRWEPYAFLSEEECGQVHDLLFADDSSQEAESLGV

SEQ ID NO: 10 - protein, 1121 aa, Fowl adenovirus A
MLIAKNVTGEWVWITSRTPVQQCPTCGRHWVRRHSCNERRSAFYYHAVQGSGSDLWQHVHFSCPAQHPHIRQLYITYDIETYTVFEKKGKRMHPFMLCFMLSGDPQLVSRAERLARQDDRLKALDEGFYWLDSHPGEVARRFRNFRSRLQIEFAQNLVDRYAAANRDYCDQLVKDGKYGSVHKIPYELFEKPTSPLSLPDNFYSVDIVVLGHNICKFDELLLATELVERRDLFPEACKCDRSFMPRVGRLLFNDIIFRMPNPNYVKKDASRVERWSRGIVSHQDARSVFVRFMVRDTLQLTSGAKLSKAAAAYALDLCKGHCPYEAINEFISTGRFHADADGFPVERYWEDPSVIAEQKNLWQKEHPGQQYDIVQACLEYCMQDVRVTQKLAHTLHDSYDAYFQRELGMEGHFNIFVRPTIPSNTHAFWKQLTFSNYVREQRATCPPSVPEPPKKKGRTKKKKQPSPDYVAEVYAPHRPMFKYIRQALRGGRCYPNVLGPYLKPVYVFDICGMYASALTHPMPHGMPLDPKFTAQHVEELNRLLTNESHLSYFDARIKPSILKIEAYPPPPEMLDPLPPICSRRGGRLVWTNEALYDEVVTVIDILTLHNRGWRVQVLHDEMNIVFPEWKTLCADYVTKNILAKEKADREKNEVIRSISKMLSNALYGAFATNMDTTRIIFEQDLSEADKKNIYEGTEIVKHVTLLNDDSFNGTEVTLENAPNPFSEESLRQQFRYADDPEQEEPEAEEDGEEEGDDSDRESARKPKNALTEDDPLVAVDLEVEATLATGPYIPEGELSSAHYARANETRFKPMRLLEATPEALTVLHLESLDKQVANKRYATQIACFVLGWSRAFFSEWCDILYGPDRGVHILRREEPRSLYGDTDSLFVTETGYHRMKSRGAHRIKTESTRLTFDPENPGLYWACDCDIKCKACGSDTYSSETIFLAPKLYGLKNSICVNEQCRTVGPGKIRSKGHRQSELIYDTLLRCWRRHEDVQFGAQSNIPELHTRRTIFKTTLLNKVSRYDPFTIHNEQLTRVLRPWKDLTLYEHGDYLYPYDNEHPNPRTTGDVRPVPIVGHEDPLAPLRWEPYAFLSEEECGQVHDLLFADDSSQEAESLGV

SEQ ID NO: 11 - protein, 1159 aa, Fowl adenovirus 9
MLVTQDQNGDWVWILSRTAVQTCPACGRHWVRNHTCNERRSAFFYHTVQKFGCDLWQHVRFACPAQQPHCKQLFLTYDIETYTVFENKGKRMHPFMLCFMLTGDPDVVRAATDLALVDPEVKTLQEGFYWLDTRPGFVARRFRAYRSRLQQHFARDLVDRYCRANGDYVSKLMSEGKYLSRYDIPYELFDKPTEPLKLPDDFNNVHIVVLGHNICKFDELLLATELVERRDVFPQACRCDRFFMPRVGRLLFNDVLFHLPNPNYDKKDPTRLHRWARGVVAPSDSRTVFVRFMVRDTLQFTSGAKLSKAAAAYALELSKGQCPYEAVNEHVSIGGYEQDSDGFPVARYWEDPSVIAEQKALWRQEHPGRPYDIVQACLEYCMQDVRVTQKLALTLYDSYDKYFKDELGMHGDFNIFLRPTIPSNTHAFWKQLTFTAYVEEQERASTVERPPSKYKRKVALKKNDIKGNPHDADVHDVERASANKNTKKRKKRLPSPEYVAEIYAPHRPMFKYIRQALRGGRCYPSVLGPYRHPVYVFDICGMYASALTHPMPHGMPLDPKFTAKHVDELNELMSSERPISYFDHRIKPCILKVEAYPPPAEHLDTLPPICSRRGGRLVWTNEALYDEVITVIDILTLHNRGWAVTALHDDMNIVFPAWKTVCAEYVSKNIAAKEKADRDKNEVMRSISKMLSNALYGAFATNMDTTRILFEQDLTEDDRRGIYEGTQIVRHVTLLNHDSLAGTVVCPESTPDAFRHHQLRQYFDRKPPTRTAEEENEEQEEEETEESEGESTSKLENALTAREASLAEVDHQLQEALDAPPYIAEDDHAHYATANETVFKPMRLLDAPPEALTVLHLENLDKMVENKRYATQIACFVLGWSRAFFSEWCEILHGPDRGTHLLQRDPQTLYGDTDSLFVTESGYRRMKERGAHRIKGPHTRLTFDPENPALYWACDCDIKCKRCGGDTYSSEAIFLAPKLYGLKDAVCLDPECGHVGSGKIRSKGHRQAELIYDTLERCWQRHEDQSYGAVSAIPELHTRRTIFKTTLLNKVSRYDPFTIHNEQLTRVLRPWKDLTQYRHGDFLYPYDTEHPNPRTADEVRRVPPVGHEEPLAPLRLLAAAAAARIAPEDDGEDSDEFDVPDRSLSIEDCDEILDLLGDP

SEQ ID NO: 12 - protein, 1159 aa, Fowl adenovirus D; identical to SEQ ID NO: 11

SEQ ID NO: 13 - protein, 1085 aa, Snake adenovirus 1
MEASTTTVKARSTHYICGHAGDSFVKIIYYKDKVKAVVSYLNMNDYLNTYALKCVIPEKITKDFFSSCPDDLLYSTLASIQRGYSPKKKEELGGKWEPLLLLYHRGEEYIIRAVVPQRRCEDCGKQFVSSHQCNVRRREFYHHAVLPDTKTWWKPIKFSPIGALSNAKRLFIIYDIETYTFHSGYGKQLVPYLLVMQFKGDSRLRCEAEKIALECGFQPYRQCFMMLNKARDVIGHKFKDMRVQLQKRAASDIWSRYREKHDILSEEGVSYAQLEAMAKDNLLKTDAEPEFTEIIVVGHNITGFDEIVLASHVLEGLPKDEELQMFKITRNFMPRAGKLLFNDVIMALPNAAFQKPKQSTFQRWKTGDLRPEDLKWEGVRFMVRDTVLLTHSSLRNAAQAYQLEVSKGHCPYDALNQYFMVGTYLCDENMYPAREYWSSDEEYLENKPPDGEKYDLVQKAVDYCVNDVKVTVALVKKLCSGYQQFCDEVLKLDCTFNVFQRPTISSTTHAMFKQMFYKSEPSAVGKFLPNLEAPSEVMYEHIRKSVRGGRCYPSFLGVFTEPHLCYDICGMYASALSHPMPYGPTLSPFDSAVAIAEFQRKLDGQSELSYFDPDIFPMIVVADAFPPSLHCLDVLPPLCSKRSGKLCWTNEPLLGEVLTTVDLIMLKNRGWRVKLIQNAECYAVWREWRPLCREYVSINIAAKEKADREKNQTQRSISKLLSNALYGSFATRLDNKQVVFMDDMSSTTQSELRSGKASIVSMTSVCSRSLPQKDTSFWERYFNLPQVEDSISAELNDEPETEPFIGGERSHVIYKPITFLSAECDNLLLATVQSNSDWVKNDRYATQVASFVLAWSRAFMSEWATILYGEDIGVPYEQRKLKSVYGDTDSLFLTGEGHRLMITKGRHKLKSSGNSLVYRDDGNLAWLVECETSCPSCKSDSFSSESCFLAPKLYALKDTTCPSCGLVSGGKLRAKGHAKSCITYDVLKSCFLDHYLLERPTEQYQSERTPIKRTLANGSANSAPFTVVEKQLARVIRPWNDPTMARGTDLSQGFLLFPYDQKRPNPRPQEPLLENPFWDDSSQTA

SEQ ID NO: 14 - protein, 1073 aa, Bovine adenovirus 4
MASKTIVKHRTTHYITGYFEDTPIKIIYYKDFKKSFFNFLQLQGLQPKAQYKSFLKPEDILQYFSEDEYPSVIKIWKLNKKFLYYDECKTDGKTMAVELVQYKNAWFLVKDIKKQQKCENCGVTFNSIHTCNVKRRDFYYHFINHETKHWWEQIKFNPVGALESTKRLFIVYDIETYTYHSTYGKQLLPYLIVFELIGSKTLQKIAAQIAYDCGFMMERGCFFMLNHRHDVIGNAFKKFRIMIQKTVAKNIWLRFSKEQEIETLLNYDEILKLNKEKKLKLAYPQYVEIFVIGHNICGFDEIVLASHVLEGIRDQENLAMFNFSRSFMPRAGKLLFNDVTLSLPNPCYKKPDKTTFERWKKGILLPEDLPWQGLKFMVRDTFLLTHCSLRNAAAAYQLNVSKGHCPYDAINDYFMLGDYEKDKNGYPVEKYWKDKAEYEQNKPNGQYNIIEEAKKYCIDDVKVTAQLVSKLIDGYQEFCNSTLKLPCLFNIFQRPTISSNTQMLFKQLHYREENINSEYLNNLEAPSEKMYSFVRASVRGGRCYPTFLGIYTEPVYVYDICGMYASALTHPMPYGRTLNPFEANTSIDEMQNMLDSSEVLSYFDPRIKAMIVVADCEPPTLEYLDVLPPLCSKKSGKLCWTNEPLINETVTSIDLITLHNRGWKCKIMKNELYAVWPNWKTLCKQYVEINIAAKERADKEKNKTQRSISKLLSNALYGSFATKIDKKKVIFAEDIEEKDKKLLREGKSEITSYTTVISSSLPKSTDYDWNKYFLNLPEVCSTTNKNLNEKSGKTAFIEKNDHVIFKPITFLSAECNDLVLTTIEDKAEWIKNNRYPTQIASFVLAWTRAFMSEWADILYGEDRGKSYSERDLKSLYGDTDSLFLSQKGHELMCSKGAHRLKHNNGKLVFDENEPQLQWLVECETVCEECHSVAFATESCFLAPKLYGLKEIKCTKCNHIGSGKLRAKGHAKECLSYDVLKRCFNDYYLLENPKENFMTKRKSLKRTLQTGNEISKPFTVVEKQLLRILRPWKDMTLRKGIQLSEGYLLYPYDKRHPNPRPQECLTENPFWDDT

SEQ ID NO: 15 - protein, 1071 aa, Ovine adenovirus 7
MASKTIIKQRTTTYITGIYEDTYIKIIYYKNFEKSFYNYFAIQGLKLNSFKKVENVLDVLKLCDSNTPVSLKIWKFNKRFFKMTEEILNGNLLPIELLILKGEIYLIKTVKQQNKCEFCGTIYSNIHNCSSRRRDFYYHNIHHETKLWWEKIKFNPVGAIKAKRLFIVYDIETYTYHSLYGKQLTPYLLVFKLIGCKSLIKIASKIATDIGYEVNRECFVMLNKKEDEIGIAFKKFRTELQISVAKKYWSTFCENHGLESNLSYEDIMVLNKEKKLKQCEPRYIELYVVGHNICGFDEIILASHVLEGIDSEELSMFKLTRSFMPRAGKLLFNDITLSLPNPCFKKPSHTTYERWKNGIINFEDMKWQGIKFMVRDTFLLTHSSLRDAATAYQLSVSKGYCPYRAINDFFMLGEYEKENNGYPVQKYWNSFEEYLQNKPKHNQKYNLLEEAKEYCIDDVIVTAQLVEKLIEGYQEFCTTSLKLECSFNIFQRPTISSNTQALFKQIFYNEEDHPSEFLRNLEAPSEKMYDFVRMSLRGGRCYPSFLGIFEEAIYVYDICGMYASALTHPLPYGKTLNAFEANAQIDYFQELLQRKEKIDYFDNSIKPMIVVADCEPPSLDYLDVLPPLCSKKSGKLCWSNETLINEVLTSIDLITLHNRGWKCKIIKSSEMYAVWSDWKPLCQKYVKVNIMAKEKASKSNNKIQRSISKLLSNALYGSFATRIDKKKVVFAENIEEKDKKRLENGSAEITSYTTVISKSLPKRSFEWNQYFSNLPEMPPKDSKDTNENFNFPLFIGNQDHVTFKPITFLSADCNDLILTTIEDKEEWIKNNRYPTQIASFVLAWTRAFMSEWAEILYGEDMGKPYIEREIKSIYGDTDSLFLTEKGHQLMLSKGLHRLKKYNSNLIFDEKHPCLTWLVECETVCNRCGAEAFSSETCILAPKLYALKDITCKNCKFIGEGKLRAKGHAKNCLNYEILKHCFTDYNLLEQPQKEFQTSRKSLKKTLQTASGTDVPFTVVEKQLTRILRPWKDQTMRKGIQWKKGYLLYPYDKRHPNPRPQEPLTENPFWENF

SEQ ID NO: 16 - protein, 1079 aa, Duck adenovirus A
MAQSSTVSRLRSTKYICGSLNGENVKITYFTDICKALNNILALNRIEKKIFTAPNLGNIIKIFPQNKQPTHITLYKLEKGLIKTEEIFSGGDIEPLLILNHKSELFIIKTYVTQEKCQTCGTLYSTNHNCNVRKTAYFHHIVNKDTRTWWQPIKFHPVGCVETKRLYVVYDIETYTYHSKYGKQLVPYLLVFQLFGEETLIDLAKAEAEMVGYTAYDGCFYILNKDPEVVGQSFKLFRSNLQDKVTNLAWERFCEDNALDPYSRITAKQLQKLNKSQKLNKTAEPQFYEIIIVGHNISGFDEIVLASHILDNVKDKDYFVMFNITRNFLPRAGKLLFNDITFSLPNPQYKKPSRGTFDRWQNGMLDKQDLKWQGVKFMVRDTYLLTHTSLRNAATAYQLPISKGCCPYEAVNEYLMTGNYEQETNGYPTLKYWNNADEYHQNKIKGPYDILKEALIYCIADVKVTSQLTRKLIEGYQSFCNDQIKLTCQFHIFQRPTISSNTHALFKQILYRAEKGQTEHLPGLQAPSEKMYDHIRKSVRGGRCYPSYLGVYEGPIYVYDICGMYASALTHPMPFGRTEDPLTASISIKTFQDKLDSPAKLSYFGESIKPMIVYADCYPPPLEHVDVLPPLCSRKSGRLCWTNEPLLGEVVTTIDLITLHNRGWKCKILTSEQLYAVWPEWKCITKEYVSINIAAKEKADKDKNMTQRSISKLLSNALYGSFATRLDNKKVVFANSMEKGDMERIANGKATITAQTTVINTCLPKKDTTSWERFFSNLPQTTALPVAPSTENEGNDINPKSFIEGAGHVTFKPITHLTAACDDLILSIIEERSEWIENNRYPTQIASFVLAWTRAFTSEWASFLFEDDWGSNIENRSLKVVYGDTDSLFLTQHGHELMITKGKHRIKGYGTALTFDPHNPNLTWLVECETVCPLCKKIAYSTESVYLAPKLYGLKNIYCEHCDVYSAGKLRAKGHAKDCINYETLKKCFIDHDLLTGRDLQYKTQRKMLKRTLTAGNTTNRPFTVVEKQLTRTLRPWADMTMWAVTQSNNGYLLFPYDKKHPNPRQQELLTENPFWEST

SEQ ID NO: 17 - protein, 1079 aa, Duck adenovirus 1; identical to SEQ ID NO: 16

SEQ ID NO: 18 - protein, 1202 aa, Murine adenovirus 3
MAQIISSVGTSSLHPESTNTNLDSSSLTGSNQIAAGTPSNAESQPSSRTPSRGRPRKATVSPLKKRKSKVIAKSHKTLKAPCPNGQYMAVGYFTSFLQPFTNLLCLQDGESFPHPNLCDLFKTSDASHKKPTVRQLTNALQKEEWPAPVTHVWFDGKYLRKSNWPNLKSPAGCYPSEPKQGSLEEKRWSWQKTRPHLTFLEIQKGTGRGPENHQMGLYLVDYIYPCERCEDCGTIFRFKHTCNARRRSYFFHNLQPLSRRWWSKISFSPLGSIPSTQRLFIIYDLETYCWHGSCGKQLVPFMIVMQFWGESTLCSTAYKVAKNTGYINYGSDPYLFYAINPQKQAIGRQFRNFRDRLQETFAREFWERNMTPEMKKYIASLPLGLLDLTPQKLPEAPQLTPKPQFIEVYVVGHNINGFDEIVVAAQVLNNRINFPPPIEVHRHFMPRNGRILFNDITFSLPNPLYEAREDFGSWEEGRLSISDSKIQYVKFMVRDTFALTHTSLRKAAEAYALPVEKGLCPYAAINDFYMTGKYESDSSDGFPSRKYWSSDEEFNEAFAQWRTEQMHDRTSFEPLQYNLIEQTLKYCIKDVQVTTKLVCKLFSSYKKFIQTEVQLPKCSFNIFQRPTISANSHAIFKQTLYTEQRPGKPNFHNCLLAPSREMYDFVRQSIRGGRCYPTYLGEVTEPIYVYDICGMYASALTHPMPTGWPLDPKARAEALENWQIKLSQREKLSYFDSHLLHGIVLIDADPPSEKDLDVLPPFCSRKGGRLCWTNETLRGEVATTIDVITLHNRGWKVKILPEDRTTLFPQMKCLVRTYVTINIAAKERADKQKNMVMRSIAKLLSNALYGSFATRQDNKCTLFTSQLQAGVIKDICEGEQKVKAIHVVETDNLSAEILTPFKALYQPAHKQARQKEPSTPMMAEGRPSSFYSHEKTLNHALSNYKPITFLEAEADDLTLVTLERSSPLVGNDRYASHLASFVLAWTRGFMSEWSEILYESDRGIALERRLNKSVYGDTDSLFVTEHGRILMETRGQHRLKKNGGKLVFNPNSPQLTWLVECETQCKRCNSDAFSPRTIFLAPKLYALQKLICQNCGEEGPGKLRAKGHAVTSLSYDMLHACFEAYRLKDNEPNFYTSRQSLRRTLISMNQQESAFTVTETTLTRSLRPWQSPTLASLGDGRLVPYSSARPNPRNRETTWIAI

SEQ ID NO: 19 - protein, 1214 aa, Murine adenovirus A
MAQIVPAFGSSGIHRKSTDTNLNPSSITGGDSSSSTTTPDADAQSSSRTPARGRPRKKATVSSPKQKQQSKVLQKAHKTLRAACPRGDHMVIGYFTSYVVPFTNLLCLQRCGPFPHPFLLDAFKAADIGHKSISVTSLTRLLQKEEWPAPVNYVWYDGLYIRQSKWPGLKGHAGRYPQVDKDASYEEKRWCWQNYRPELTFLHIQKGLGTKGSNYHKIGLYLVDTMHPCQRCEDCGSFFRFKHTCNARRRSFFFHNLKPLSRQWWTKISFTPLGSIPTTKRLFIIYDLETYCWHGSCGKQLVPFMLVMELYGDMFLCAKAHSIAKQMGYSEHHLRPYILWSINPQKEAIGRQFRRFRDRLQEAFAEELWQNNIYPELQTYIDSLPLGLLDLTPERLEQEAPPLKNTPKFIEVYVVGHNINGFDEIVVAAQVLNNRVNFPPPLRVHRHFMPRNGRILFNDITFSLPNPRYKKRTDFEQWEQGCLTTSDSKIQYVKFMVRDTFALTHTSLRKAAEAYSLPLEKGVCPYAAVNDFYMTGRYDTINIFDGFPHRKYWNSEAEYEEGLQEWKKEKEELRKRCPDRVCPIKYNLIEHTLKYCIQDVTVTTKLVCKLLDSYHHFIQNAVGLPKCLFNIFQRPTISANSHAIFKQTLYSELRPEKPNFDDVLLAPSREMYDFVRQSIRGGRCYPTVLGELKEPIYVYDICGMYASALTHPMPSGWPLEPKARAEALADWTKHLSNSAPISYFNTCLLHGIVLIDADPPCETQLDVLPPFCSRKGGRLCWTNEPLRGEITTTIDVITLHNRGWKVNILPEALTTLFPHMKCLVRKYVTINITAKEKADRQKNMVMRSIAKLLSNALYGSFATRQDNKSTVFASQLYPGTIKEICTGRQKIKALHVVETDNLCAEILTEFKTIYQPSCENTRPPHVADSAELSPRGSHPAPFYREQQVVDHALFNFKPIKFLDAEADDLTLVTLEHSNPLVDNDRYASHLASFVLAWTRGFMSEWSDILYESDRGLQLEKRLIKSVYGDTDSLFVTEAGRNLMESRGKHRLKKNGGKLVFNPEKPSLTWLVECETQCKYCGSDAFSPRTVFLAPKLYALQKLVCPTCGQEGAGKLRAKGHAVASLSYDILLACYEAYRLNESDPNFYTSRQSLKRTLVNMNKQESAFTVTETVLTRSLRPWQNPTLALLEDGRLIPYSTAHPNPRNRETTWIAL

SEQ ID NO: 20 - protein, 1023 aa, Bovine adenovirus 3
MCVYKTYKGKLKITSIPARADRPRLPFPLNFLIHKRKLYLIDTIAEVQRCADCGSYFKQTHTCSTRRRDFYFHHINTQSSDWWEEIKFFPWAAHPDTRRLFVVYDVETYTWHGSFGKQLMPFMLVFTLFGDAQLCEQAVNIAKKQKWSSWPKQANTFYYLNPQRNKVGSLFKQYRDALQEAASTLLWRQFLADNPCLENLCLKLGYVHASDIPFEELCTLELKGQPTFLEVYVVGHNINGFDEIVLAAQVINNKQGIPAAFKVSRNFMPRCGKILFNDLTFALPNPTHAARKDFKDWEEGTPTSADYKFQFVKFMVRDTFALTHTSLRNAAAAYALPVEKGCCPYKAVNEFYMLGTYRTDADSFPQRDYWSSDEEYLLNKSLWLQENSGAYDIVQRTLDYCAMDVLVTAELVKKLQASYLDFVHTSVGLPHCNFNVLQRPTISSNSHAIFRQVVYRSQRPNRSSLGNFLLAPSNEMYDYVRESIRGGRCYPTYIGVLTEAIYVYDICGMYASALTHPFPAGKPLNPFDRALAIKNWQDRLTQLHRPIDYFDRTLLPAIFTIDADPPPEAFLDVIPPFCSRKGGRLCWTNETLRGEVVTCLDAITLHNRGWRVQILNDPRTTVFPQWECLARDYVQLNIAPKERADKEKNQTLRSIAKLLSNALYGSFATKLDNRVTVFSDQMEDKYVRGISDGTYDIKSTAFVETDNLSSSVMAELKITYSPVKQQTDATRKHRQCTPTSNSSSDEDAPFYTLGDPQNHHVTYTYKPITFLEADDSALCLHTLQKKSSLIFNNRYPSHIASFVLAWTRAFVSEWADILYLEDRGTPLEDRILKFVYGDTDSMFLTQRGKELMDTRGKHRLKGNNRPLVFDPTNPQLTWLVECETQCPRCHGDAHSQESVFLAPKLYALKNIYCPSCRRREFWQTSSKGHATSQLSYDLLVTCYYSTEQLGDEKFGTSRLSLRRSLVSRQTHQQPFTVTETTLARTLRPWKDRTLRAIDRHRLAPYSNSHPNPRNKELCWMEMY

SEQ ID NO: 21 - protein, 1163 aa, Bovine adenovirus B
MALVQSDGASSIHPTPGDSENQPQSRAARIRPAPTAATHARTQRSGPATAPQARKAKAAPRPSTSPLKKAPRGPLVAKRSTLRLHGQTEDGTTLEVKYHADVSSSLRNLFELHLEHCPFDLKPENILSFQDTLVRFCNANMCVYKTYKGKLKITSIPARADRPRLPFPLNFLIHKRKLYLIDTIAEVQRCADCGSYFKQTHTCSTRRRDFYFHHINTQSSDWWEEIKFFPWAAHPDTRRLFVVYDVETYTWHGSFGKQLMPFMLVFTLFGDAQLCEQAVNIAKKQKWSSWPKQANTFYYLNPQRNKVGSLFKQYRDALQEAASTLLWRQFLADNPCLENLCLKLGYVHASDIPFEELCTLELKGQPTFLEVYVVGHNINGFDEIVLAAQVINNKQGIPAAFKVSRNFMPRCGKILFNDLTFALPNPTHAARKDFKDWEEGTPTSADYKFQFVKFMVRDTFALTHTSLRNAAAAYALPVEKGCCPYKAVNEFYMLGTYRTDADSFPQRDYWSSDEEYLLNKSLWLQENSGAYDIVQRTLDYCAMDVLVTAELVKKLQASYLDFVHTSVGLPHCNFNVLQRPTISSNSHAIFRQVVYRSQRPNRSSLGNFLLAPSNEMYDYVRESIRGGRCYPTYIGVLTEAIYVYDICGMYASALTHPFPAGKPLNPFDRALAIKNWQDRLTQLHRPIDYFDRTLLPAIFTIDADPPPEAFLDVIPPFCSRKGGRLCWTNETLRGEVVTCLDAITLHNRGWRVQILNDPRTTVFPQWECLARDYVQLNIAPKERADKEKNQTLRSIAKLLSNALYGSFATKLDNRVTVFSDQMEDKYVRGISDGTYDIKSTAFVETDNLSSSVMAELKITYSPVKQQTDATRKHRQCTPTSNSSSDEDAPFYTLGDPQNHHVTYTYKPITFLEADDSALCLHTLQKKSSLIFNNRYPSHIASFVLAWTRAFVSEWADILYLEDRGTPLEDRILKFVYGDTDSMFLTQRGKELMDTRGKHRLKGNNRPLVFDPTNPQLTWLVECETQCPRCHGDAHSQESVFLAPKLYALKNIYCPSCRRREFWQTSSKGHATSQLSYDLLVTCYYSTEQLGDEKFGTSRLSLRRSLVSRQTHQQPFTVTETTLARTLRPWKDRTLRAIDRHRLAPYSNSHPNPRNKELCWMEMY

SEQ ID NO: 22 - protein, 1192 aa, Simian adenovirus 22
MALVQTHGSRGLHPEASDPGRQPSRRRSRQSSPGAVPEPARARRRRAPAAPASGPRAAPAARRASSPPLLSMEPPPPAPKKKRGTVVAPQGHGTLQAVDVATNGAVEIKYHLDLPRALEKLLQVNRAPPLPTDLTPQRLRTLDSSGLRALVLALRPVRAEVWTCLPRGLVSMTTIEADDGHADGQDVVQHQMQPPALHCPLKFLVKGTQVQLVQHVHPVQRCEHCGRLYKHKHECSARRRHFYFHHINSHSSNWWQEIQFFPIGSHPRTERLFLTYDVETYTWMGSFGKQLVPFMLVMKLSGDPPLVELAHDLALQLKWDRWHGDPRTFYCVTPEKMAVGQQFRQYRDRLQTALAVDLWTSFLGANPHLADWALEQHGLSDPAELTYDELKKLPHVKGRPRFVELYIVGHNINGFDEIVLAAQVINNRAEVPQPFRITRNFMPRAGKILFNDVTFALPNPAYKKRTDFQLWEQGGCDDLDFKHQFLKVMVRDTFALTHTSLRKAAQAYALPVEKGCCAYKAVNQFYMVGSYRADQDGFPLEEYWKDREEFLLNRELWKQKGQLKYDIIQETLDYCALDVLVTAELVAKLQDSYAHFIRDSVGLPHAHFNIFQRPTISSNSHAIFRQIVYRAEKPQRSNLGTGLLAPSHELYDYVRASIRGGRCYPTYIGVLEEPLYVYDICGMYASALTHPMPWGTPLSPYERALAVRDWQAALDDLGTCISYFDPELLPGIFTVDADPPDELMLDPLPPFCSRKGGRLCWTNEPLRGEVATSVDLITLHNRGWRVRIVPDKLTTVFPEWKCVAREYVQLNIAAKERADKEKNQTMRSIAKLLSNALYGSFATKLDNKKIVFSDQMDEGLMKGVSNGTVNIKSSSFLETDNLSAEVMPAFEREYLPQQLALLDSDPEDSEDEQGPAPFYTPPAGTPGHVAYTYKPITFLDVDEGDMCLHTLEKVDPLVDNDRYPSHVASFVLAWTRAFVSEWAGFLYDEDRGTPLEDRPIKSVYGDTDSLFVTQRGHELMETRGKKRIKKHGGNLVFDPDRPDLTWLVECETVCASCGADAYAPESVFLAPKLYALKSLLCPVCGHTSKGKLRAKGHAAEALNYELMLNCYLADAQGADRERFSTSRMSLKRTLASAQPGAHPFTVTETTLTRTLRPWKDRTLASLDAHRLVPYSRSRPNPRNEEVCWIEMP

SEQ ID NO: 23 - protein, 1190 aa, Simian adenovirus 23
MALVQTHGSRGLHPEASDPGRQPSRRRSRQSSPGAVPEPARARRRRAPAAPASGPRAAPAARRASSPPLLTDMEAAPKKKRGTVVAPQGHGTLQAVDVATNGAVEIKYHLDLPRALEKLLQVNRAPPLPTDLTPQRLRTLDSSGLRALVLALRPVRAEVWTCLPRGLVSMTTIEADDGHADGQDVVQHEMQPPALHCPLKFLAKGTQVQLVQHVHPVQRCEHCGRLYKHKHECSARRRHFYFHHINSHSSNWWQEIQFFPIGSHPRTERLFLTYDVETYTWMGSFGKQLVPFMLVMKLSGDPPLVELAHDLALQLKWDRWHGDPRTFYCVTPEKMAVGQQFRQYRDRLQTALAVDLWTSFLSANPHVADWALEQHGLSDPAELTYDELKKLPHVKGRPRFVELYIVGHNINGFDEIVLAAQVINNRAEVPQPFRITRNFMPRAGKILFNDVTFALPNPAYKKRTDFQLWEQGGCDDLDFKHQFLKVMVRDTFALTHTSLRKAAQAYALPVEKGCCAYKAVNQFYMVGSYRADQDGFPLEEYWKDREEFLLNRELWKQKGQLKYDIIQETLDYCALDVLVTAELVAKLQDSYAHFIRDSVGLPHAHFNIFQRPTISSNSHAIFRQIVYRAEKPQRSNLGTGLLAPSHELYDYVRASIRGGRCYPTYIGVLEEPLYVYDICGMYASALTHPMPWGTPLSPYERALAVRDWQAALDNLGTCISYFDPELLPGIFTVDADPPDELMLDPLPPFCSRKGGRLCWTNEPLRGEVATSVDLITLHNRGWRVRIVPDELTTVFPEWKCVAREYVQLNIAAKERADKEKNQTMRSIAKLLSNALYGSFATKLDNKKIVFSDQMDEGLMKGVSNGTVNIKSSSFLETDNLSAEVMPAFEREYLPQQLALLDSDPEDSEDEQGPAPFYTPPAGTPGHVAYTYKPITFLDVDEGDMCLHTLEKVDPLVDNDRYPSHVASFVLAWTRAFVSEWAGFLYDEDRGTPLEDRPIKSVYGDTDSLFVTQRGHELMETRGKKRIKKHGGNLVFDPNRPDLTWLVECETVCASCGADAYAPESVFLAPKLYALKSLLCPVCGHTSKGKLRAKGHAAEALNYELMLNCYLADAQGADRERFSTSRMSLKRTLASAQPGAHPFTVTETTLTRTLRPWKDRTLASLDAHRLVPYSRSRPNPRNEEVCWIEMP

SEQ ID NO: 24 - protein, 1190 aa, Simian adenovirus 24
MALVQTHGSRGLHPEASDPGRQPSRRRSRQSSPGAVPEPARARRRRAPAAPASGSRAAPAARRASSPPLLTGMEAAPKKKRGTVVAPQGHGTLQAVDVATNGAVEIKYHLDLPRALEKLLQVNRAPPLPTDLTPQRLRTLDSSGLRALVLALRPVRAEVWTCLPRGLVSMTTIEADDGHADGQDVVQHQMQPPALHCPLKFLVKGTQVQLVQHVHPVQRCEHCGRLYKHKHECSARRRHFYFHHINSHSSNWWQEIQFFPIGSHPRTERLFLTYDVETYTWMGSFGKQLVPFMLVMKLSGDPPLVELAHDLALQLKWDRWHGDPRTFYCVTPEKMAVGQQFRQYRDRLQTALAVDLWTSFLSANPHVADWALEQHGLSDPAELTYDELKKLPHVKGRPRFVELYIVGHNINGFDEIVLAAQVINNRAEVPQPFRITRNFMPRAGKILFNDVTFALPNPAYKKRTDFQLWEQGGCDDLDFKHQFLKVMVRDTFALTHTSLRKAAQAYALPVEKGCCAYKAVNQFYMVGSYRADQDGFPLEEYWKDREEFLLNRELWKQKGQLKYDIIQETLDYCALDVLVTAELVAKLQDSYAHFIRDSVGLPHAHFNIFQRPTISSNSHAIFRQIVYRAEKPQRSNLGTGLLAPSHELYDYVRASIRGGRCYPTYIGVLEEPLYVYDICGMYASALTHPMPWGTPLSPYERALAVRDWQAALDDLDTCISYFDPELLPGIFTVDADPPDELMLDPLPPFCSRKGGRLCWTNEPLRGEVATSVDLITLHNRGWRVRIVPDELTTVFPEWKCVAREYVQLNIAAKERADKEKNQTMRSIAKLLSNALYGSFATKLDNKKIVFSDQMDEGLMKGVSNGTVNIKSSSFLETDNLSAEVMPAFEREYLPQQLALLDSDPEDSEDEQGPAPFYTPPAGTPGHVAYTYKPITFLDVDEGDMCLHTLEKVDPLVDNDRYPSHVASFVLAWTRAFVSEWAGFLYDEDRGTPLEDRPIKSVYGDTDSLFVTQRGHELMETRGKKRIKKHGGNLVFDPNRPDLTWLVECETVCASCGADAYAPESVFLAPKLYALKSLLCPVCGHTSKGKLRAKGHAAEALNYELMLNCYLADAQGADRERFSTSRMSLKRTLASAQPGAHPFTVTETTLTRTLRPWKDRTLASLDAHRLVPYSRSRPNPRNEEVCWIEMP

SEQ ID NO: 25 - protein, 1184 aa, Simian adenovirus 7
MALVQDPGAGGLHAETAHPGPQPPRRRPRQQSPGSSSTAAESSRKRASASAAPRRRAASTPRRSPSTSEIKPPRGTVVAPRGHGLLYAVDASSNTPLEIKYHLHLAHALTGLLKVNLQTLPADLSATSLDSLDSGQLRPLLQRLHPSVAEIWTCGTRGVVVPTVVHPEKEDADADSHRQGEGDVAPPAPRLNFPLRFLVRGRKAHLVQEIQSVQRCDYCGRFYKHQHECSVRRRDFYFHHINTHSSSWWQEISFFPIGSHARTQRLFVTYDVETYTWMGSFGKQLVPFMLVMHVSGEETLVRQACELALELRWDVWNNRPNTFYVVTPEKMAVGKKFREFRDRLQTLLALDLWSSFLAANPQLSDWARAELGLSSPDCLTYEELKKAPALKGQPRFIELYIVGHNINGFDEIVLAAQVINNRSDVPGPFRISRNFMPRAGKILFNDVTFALPNPRQKKRTDFTLWEQGACDDTDFKHQYLKVMVRDTFALTHTSLRKAAQAYALPVEKGCCPYKAVNEFYMLGSYRADEKGFPAEEYWKDREEYLLNRELWEKKQETAYNLVRETLDYCALDVLVTAALVDKLRESYAQFIQDSVGLPGANFNVFQRPTISSNSHAIFRQILYRAEKPHKTHLGDGLMAPSREMYDYVRASIRGGRCYPTYIGVLREPLYVYDICGMYASALTHPMPWGPPLNPYERALAVKKWEDALQDTDTEIDYFNKILLPGIFTIDADPPPANLLDPLPPFCSRKGGRLCWTNEPLRGEVATSVDLITLHNRGWRVRILPDERTAVFPEWRCAAREYVQLNIAAKERADREKNQTLRSIAKLLSNALYGSFATKLDNKKIVFSDQMDPSTIKSIAAGHVNIKSTSFVETDNLSAEIMPAFERAYSPEQLALVHSDAEESDGEGGHAPFYTPLGGADHVTYTYKPITFVDAEEDDLCLHTLEKVDPLIENDRYPSQIASFVLAWTRAFVSEWSQFLYAEDLGTPLEDRPLKSVYGDTDSLFVTEAGHKLMETQGKKRIKKNGGNLVFDPAKPELTWLVECETVCAQCGADAYSPESVFLAPKLYALQCLHCTKCQHVSKGKLRAKGHAAESLSYDLMLRCYLADSQGDDVRFSTSRMSLKRTLASAQPGAHPFTVTETTLTRTLRPWKDRTLAALDAHRLVPYSESRPNPRNQEVCWIEIP

SEQ ID NO: 26 - protein, 1184 aa, Simian adenovirus 1
MALVQDPGAGGLHAETAHPGPQPPRRRPRQQSPGSSSTAAESSRKRATASAAPRRRAASTPRRSPSTSEIKPPRGTVVAPRGHGLLYAVDASSNTPLEIKYHVHLAHALTGLLKVNLQTLPADLSAAALDSLDSGQLRPLLQRLRPSVAEIWTCGTRGVVVPTVVHPEKEGADADSHRQGEGDAAPPSPRLNFPLRFLVRGRKAHLIQEIQSVQRCDYCGRFYKHQHECSVRRRDFYFHHINTHSSNWWQEISFFPIGSHARTQRLFVTYDVETYTWMGSFGKQLVPFMLVMHVSGEETLVRQACELALELRWDVWNDRPCTFYVVTPEKMAVGKKFREFRDRLQTLLALDLWSSFLAANPQLSDWARAELGLSSPDCLTYEELKKAPALKGQPRFIELYIVGHNINGFDEIVLAAQVINNRSDVPGPFRISRNFMPRAGKILFNDVTFALPNPRQKKRTDFTLWEQGACDDTDFKHQYLKVMVRDTFALTHTSLRKAAQAYALPVEKGCCPYKAVNEFYMLGSYRADEKGFPAEEYWKDREEYLLNRELWEKKQETAYNLVRETLDYCALDVLVTAALVDKLRESYAQFIQDSVGLPGANFNVFQRPTISSNSHAIFRQILYRAEKPHKTHLGDGLMAPSHEMYDYVRASIRGGRCYPTYIGVLREPLYVYDICGMYASALTHPMPWGPPLNPYERALAVKKWEDALQDTDTEIDYFNKILLPGIFTIDADPPPANLLDPLPPFCSRKGGRLCWTNEPLRGEVATSVDLITLHNRGWRVRILPDERTAVFPEWRCVAREYVQLNIAAKERADREKNQTLRSIAKLLSNALYGSFATKLDNKKIVFSDQMDPSTIKSIAAGHVNIKSTSFVETDNLSAEIMPAFERAYSPEQLALVHSDAEESDGESGHAPFYTPWGGAGHVTYTYKPITFVDAEEDDLCLHTLEKVDPLIENDRYPSQIASFVLAWTRAFVSEWSQFLYAEDLGTPLEDRPLKSVYGDTDSLFVTEAGHRLMETQGKKRIKKNGGNLVFDPAKPELTWLVECETVCAQCGADAYSPESVFLAPKLYALKCLHCTKCQHVSKGKLRAKGHAAESLSYDLMLRCYLADSQGDDARFSTSRMSLKRTLASAQPGAHPFTVTETTLTRTLRPWKDRTLAALDAHRLVPYSESRPNPRNQEVCWIEIP

SEQ ID NO: 27 - protein, 1169 aa, Simian adenovirus 3
MALVQDHGSGGLHATPPDPGRQSPGDSLCQSAPRAAPAPARAPRRRAAARLARGSRAAAAAGSPSPPPIKTPRGTLVAPRPHGHLFALDARDRHPWEIKYHLHLLPALTHLLEVHRLPPLPDNFRVHDSPSDETLRELVQELKPQLAEVWSVRGRGTVEPSSILPADAEVAARSFPLRFLALGPPQRRKIHLIHSLHSVSRCDHCGRFYKNQHECSTRRRDFYFHHIHAQSSQWWQPIKFFPLGSHPRTERLFLTYDVETYTWMGAFGKQLVPFLLVMKITGEPSLVRLALNLARELGWDAWREHADTFFCLNPQKQAIGRKFREFRDRLQLLLVDHIWQDFVERNPVEDWSRTEHGVEPRELTFQQLEKCPLLRGAPRFIEFYVVGHNINGFDEILLAAQVINNRSEVPGPFRISRNFMPRCGKILFNDVTYSLPNPKHKKRTDYSDWERGMCDDRDFKYQFVKVMVRDTFALTHTSLRKAALAYSLPVEKGCCPYQAVNQFYMLGSYRGDEDGFPLQEYWKDREEYLFNRDLWKEKKEEHYDIVRETLDYCALDVLVTASLVEKLQESYAHFIGEAVGLPDARFNIFQRPTISSNSHAIFRQILFRDEKPQRAHLSRHLLAPSHELYDYVRASIRGGRCYPTYLGVLEEPLYVYDICGMYASALTHPMPWGAPLSPYERALAVRDWETALRRPGHQIDYFDKHLLPAIFTIDADPPDERLLDPLPPFCSRKGGRLCWTNEPLRGEVATSIDVITLHNRGWSVRLVPDERTAVFPGWKCVAREYVQLNIAAKEKADREKNQTQRSIAKLLSNALYGSFATKLDNRQIVFSDQMGPEHLKGISTGALAIKSSSYIETDNLSAQVMPAFTRVYVPQQLAFGDSEPEESDEEGGNAPFYTPAEGQDHVTYTYKPITFLEADEGDMCLHTLEKTDPLIDNDRYPSHIASFVLAWTRAFMSEWCEFLYAEDRGTPLEERALTSVYGDTDSLFVTERGHRLMETRGRKRIKKNGGRLVFDPKDPQLTWLVECETVCSNCGGDAYSPESVFLAPKLYALKCLLCSNCGHVSKGKLRAKGHAAESLDYELMVRCYLADLQGDEKQRFATSRLSLKRTLASAQPGAHPFTVTETTLKRTLRPWRDRTMAQLDAHRLIPYSQSRPNPRNEEVCWIEMP

SEQ ID NO: 28 - protein, 1017 aa, Bovine adenovirus 2
MLEALKPAEGATFTYIKGRLIKQQAAVENPILPFPIFFLIKQNKVFLIKSFQSSQKCEFCGDFFANSHTCSVRRRDFYFHHINFKSSEWWSQISFQPIGSCDDTKRFFLTYDVETYTWHGKHGKQLVPFMLVFHLSGELELVSLSANIAEQQRWLAWDTPHTYYYVSPIKGEIGKAFKDLRYEIQKQVTRLLWDNFVGENPELAEIQERHHVNHIDDITAEMHKIKTKGSPQFIEIYVIGHNICGFDEIVLAAQVIHNRTDVLPAFKINRNFMPRNGKILFNDISFCLPNPKYEKRKDFADWECGKLTAADHKYQFVKFMVRDTFALTHTSLRNAAGAYELPVEKGSCPYEAVNEFYRIGSYQQDEDGFPSLRYWKSSEEYQLNKALWREKNVGAYDIIQQTLHYCVQDVLVTSALVNKLQESYKNFIASQVNLPDASFNIFQRPTISSNSHAIFKQILYREVRPNKANLDNVLLAPSHEMYDYVRQSIRGGRCYPTYIGIMEQPIYVYDICGMYASALTHPFPSGQPLNPYERALAATEWIRKLENLEQKIDYFDECLLPGIFTIDADPPDELFLDELPPFCSRKGGRLCWANEPLRGEVATSIDLITLHNRGWAVRILPDERTTIFPEWKCVAKEYVQLNIGAKEKADKEKNQTMRSIAKLLSNALYGSFATKLDNKKIVFSDQLEASASKTIARGNFSIKSSSFIETDNFSAEIMPEFVVTYPPAPSAELDESDENEEHTLFIPKDSHVTYKYKPITFLETEDDDICLHTLENNSPLIENNRYASHIASFVLAWTRVFVSEWAEFLYAEDRGKPLHQRTIKSVYGDTDSLFVTEEGHRLMEQRGKHRIKKNGGKLVFDPKNPSITWLVECETQCEKCKSDAFSSESVFLAPKLYALKNTVCTCCGHVGKGKLRAKGHATTELCYDTLAKCYLSDAQQGSQRFHTSRLSLKRTLATNQSNAAPFTVTETTLTRTVRPWKDKTLVDIDGHRLMPYSKSNPNPRNNDVCWMTLPWNM

SEQ ID NO: 29 - protein, 1017 aa, Ovine adenovirus A; identical to SEQ ID NO: 28

SEQ ID NO: 30 - protein, 1130 aa, Porcine adenovirus C
MSVVPSDGSGRLLGAEGHPKHQQKGRGHGDEAETGRQTYAGTARGRPARSGPVRGNLVAKRATLSASGTLEDGTHVDIKFHSKTLEALENLFHLHLLQLPPLPPISTSNVSDVLQLLAPREGSVVVYNRGRVSVKQVEIREPKAHFDIQFLLKQGKVYLIKEIQDTQKCEYCGDFFKTSHTCSVRRRDFYFHHVHHKSSDWWENIPFQPLGSYRETERLYITYDVETYTWHGKHGKQLVPFLLVFHISGEPHLVKVAESVAQDLNWCPWTEKHTFYYLNPQKSAVGRMFKSFRDELQNRVTQDLWKTFLSQNPHLVETAARLNLGSVDDITPEVLKKEKICGEPRFIEVYVIGHNISGFDEIVLAAQVICHQSKTIKAFKISRNFMPRNGKILFNDITFGLPNPLFEKRKEFQEWERGSMAVQDMKQQFVKLMVRDTLMLTHTSLRNAAKAYDLPVEKGCCPYEAVNEFYRTGTYQKDEDGFPSLRYWKDQEEYALNKELWREKKCGAYDLISSTLTYCAQDVLVTSSLVRKLQESYQSFIANEVNLPDSSFNIFQRPTISSNSHAIFKQILYRAEKPERQHLGEVLLAPSNEMYDYVRQSIRGGRCYPTYIGILHEPIYVYDICGMYASALTHPMPSGSPLNPFERALAVAVWEDQLKSVGQKMDYFDEKLLPGIFTIDADPPDESFLDVLPPFCSRKGGRLCWTNEPLRGEVATSVDVITLHNRGWRVRLVPDERTTIFPEWKCLAKEYVQLNIAAKEKADREKNQTMRSIAKLLSNALYGSFATRLDNKKIVFSDQLEEESSKNISRGKYSVKSSSFIETDNFSADIMPEFVVAYPPVADVSNEDNEAAEEATPFIGKSDHVTYKYKPITFLDVEDDDVCLHTLESSSSLVLNNRYASHLASFVLAWARVFVSEWSEFLYENDRGVPMEERQIKSVYGDTDSLFVTEEGHRLMKEKGKHRIKKNGGSLVFDPQHPQVTWLVECETRCDKCGEDAYSPTSVFLAPKLYALKSTVCSVCGYVGKGKLRAKGHATSELSFDVLQRCYLEDLQLGSEKFKTSRLSLKRTLASCQSNAAPFTVTEATLTRTLRPWKDKTLTQIDQNRLIPYSTSRPNPRNTDLCWMTLPWDS

SEQ ID NO: 31 - protein, 1136 aa, Tree shrew adenovirus
MALVQSDRPRSLQPESGNSKHQPESRRLRVSSEAATPASSGPQPSRSSAPALTRYKGTVVAKRATCVINATDEEGCFVEIKYHVDTDKSLQALFDVHLSERPEEAGNFTAHNVVAKLEAIRPSQASIVKYFRGKIKTTHVAIENPRFSFPIRFLIKNHQLFLIKEICTTMKCEHCGRYFKGTHTCSARRRDFYFHHINAQSSSWWEPISFFPLGAPPETKRLYITYDVETYTWHGKFGKQLVPFMLVLHLSGDDELLADAITLIRQTSYIPWPKHDNTFYYLNPTKKTVGQLFKSLRNTLQTHFAKKLWQLFLDQNPKITEYCQLKQLDPDQLTADELKNMKIVGTPSFWEVYVVGHNINGFDEIVLAAQIISNKSDVPASFHITRNFMPRNGKILFNDITFGLPNPASKKRQDFTLWEQGGCEASDFKWQYVKFMVRDTFALTHTSLRKAAAAYALDVEKGSCPYKAVNEFYMFGSYQVDEVGFPDEHYWSSREEYLFNREEWLKKKEHAYDIITQTLEYCVMDVVVTAKLVQKLQTSYAAFVQESVNLPESSFNVFQRPTISSNSHAIFRQIVYRAEKPQKTHLGQCLLAPSNEMYDYVRSSIRGGRCYPSYIGLLSEPIYVYDICGMYASALTHPFPSGRPLNPFDRALAVKNWEMRLKNSQTIDYFTPHLLPGIFTIDADPPSETYLDVLPPFCSRKGGRLCWTNESLRGEVATSVDIITLHNRGWKVRIVTDERTTVFPEWKCIAQEYVKLNIAAKEKADKEKNQTIRSIAKLLSNALYGSFATKLDNKKTVFADQLDSSTAKGIANGEFSVKSSSFIETDCLSAEIMSELVVAYSPDTLLHPQQEGATEANTQETPTFIGPTDHVTYTYKPITFLEAEEDEICLQTIEKNSPLIPNDRYPSHIASFVLAWTRAFVSEWASFLYSEDLGTPMERRCLKSVYGDTDSLFLTEEGRRLMETKGKHRIKKNGGKLVFDPANPDLTWLVECETQCEKCGADAFSSQSIFLAPKLYALKDTTCPVCKHVGKGKLRAKGHATDGLSFEIMSKCYFADSQLGSDKFQTSRMSIKRTLASGQSHVQPFTVTETTLTRTLRPWKDKTMTALDQHRLIPYSNSCPNPRNNEVCWIEMSETM

SEQ ID NO: 32 - protein, 1198 aa, Human adenovirus 5
MALVQAHRARRLHAEAPDSGDQPPRRRVRQQPTRAAPAPARARRRRAPAPSPGGSGAPPTSGGSPASPLLDASSKDTPAAHRPPRGTVVAPRGCGLLQAIDAATNQPLEIRYHLDLARALTRLCEVNLQELPPDLTPRELQTMDSSHLRDVVIKLRPPRADIWTLGSRGVVVRSTVTPLEQPDGQGQAAEVEDHQPNPPGEGLKFPLCFLVRGRQVNLVQDVQPVHRCQYCARFYKSQHECSARRRDFYFHHINSHSSNWWREIQFFPIGSHPRTERLFVTYDVETYTWMGAFGKQLVPFMLVMKFGGDEPLVTAARDLAANLGWDRWEQDPLTFYCITPEKMAIGRQFRTFRDHLQMLMARDLWSSFVASNPHLADWALSEHGLSSPEELTYEELKKLPSIKGIPRFLELYIVGHNINGFDEIVLAAQVINNRSEVPGPFRITRNFMPRAGKILFNDVTFALPNPRSKKRTDFLLWEQGGCDDTDFKYQYLKVMVRDTFALTHTSLRKAAQAYALPVEKGCCAYQAVNQFYMLGSYRSEADGFPIQEYWKDREEFVLNRELWKKKGQDKYDIIKETLDYCALDVQVTAELVNKLRDSYASFVRDAVGLTDASFNVFQRPTISSNSHAIFRQIVFRAEQPARSNLGPDLLAPSHELYDYVRASIRGGRCYPTYLGILREPLYVYDICGMYASALTHPMPWGPPLNPYERALAARAWQQALDLQGCKIDYFDARLLPGVFTVDADPPDETQLDPLPPFCSRKGGRLCWTNERLRGEVATSVDLVTLHNRGWRVHLVPDERTTVFPEWRCVAREYVQLNIAAKERADRDKNQTLRSIAKLLSNALYGSFATKLDNKKIVFSDQMDAATLKGITAGQVNIKSSSFLETDNLSAEVMPAFQREYSPQQLALADSDAEESEDERAPTPFYSPPSGTPGHVAYTYKPITFLDAEEGDMCLHTLERVDPLVDNDRYPSHLASFVLAWTRAFVSEWSEFLYEEDRGTPLEDRPLKSVYGDTDSLFVTERGHRLMETRGKKRIKKHGGNLVFDPERPELTWLVECETVCGACGADAYSPESVFLAPKLYALKSLHCPSCGASSKGKLRAKGHAAEGLDYDTMVKCYLADAQGEDRQRFSTSRTSLKRTLASAQPGAHPFTVTQTTLTRTLRPWKDMTLARLDEHRLLPYSESRPNPRNEEICWIEMP

SEQ ID NO: 33 - protein, 911 aa, Bovine adenovirus 3
MATPSMLPQWSYMHIAGQDASEYLSPGLVQFAQATESYFNIGNKFRNPTVAPTHDVTTERSQRLQLRFVPVDREDTQYSYKTRFQLAVGDNRVLDMASTYFDIRGTLDRGASFKPYSGTAYNSFAPKSAPNNTQFRQANNGHPAQTIAQASYVATIGGANNDLQMGVDERQLPVYANTTYQPEPQLGIEGWTAGSMAVIDQAGGRVLRNPTQTPCYGSYAKPTNEHGGITKANTQVEKKYYRTGDNGNPETVFYTEEADVLTPDTHLVHAVPAADRAKVEGLSQHAAPNRPNFIGFRDCFVGLMYYNSGGNLGVLAGQSSQLNAVVDLQDRNTELSYQMLLANTTDRSRYFSMWNQAMDSYDPEVRVIDNVGVEDEMPNYCFPLSGVQIGNRSHEVQRNQQQWQNVANSDNNYIGKGNLPAMEINLAANLWRSFLYSNVALYLPDNLKFTPHNIQLPPNTNTYEYMNGRIPVSGLIDTYVNIGTRWSPDVMDNVNPFNHHRNSGLRYRSQLLGNGRFCDFHIQVPQKFFAIRNLLLLPGTYTYEWSFRKDVNMILQSTLGNDLRVDGATVNITSVNLYASFFPMSHNTASTLEAMLRNDTNDQSFNDYLSAANMLYPIPPNATQLPIPSRNWAAFRGWSLTRLKQRETPALGSPFDPYFTYSGTIPYLDGTFYLSHTFRKVAIQFDSSVTWPGNDRLLTPNEFEIKISVDGEGYNVAQSNMTKDWFLVQMLANYNIGYQGYHLPPDYKDRTFSFLHNFIPMCRQVPNPATEGYFGLGIVNHRTTPAYWFRFCRAPREGHPYPQLALPPHWDPRHALRDPERKFLCDRTLWRIPFSSNFMSMGSLTDLGQNLLYANAAHALDMTFEMDPINEPTLLYVLFEVFDVARVHQPHRGVIEVVYLRTPFSAGNATT

SEQ ID NO: 34 - protein, 917 aa, Ovine adenovirus 6
MATPSMLPQWSYMHIAGQDASEYLSPGLVQFAQATESYFNLNNKFRNPTVAPSHDVTTERSQRLQLRFVPVDREDTQYSYKTRFTLAVGDNRILDMASTYFDIRGTLDRGPSFKPYSGTAYNSLAPRSCPNNTQFAPAQNGYPHRVIAQASYAGAIEGQNDELRVGANERGQPVYADARYQPEPQIGVEGWTAGTLATINQAGARVLRNTPARPCYGSYAAPTNPEGGQARVGTQVQKDYYRVDANGNGNPNAVLYSEEVDLKTPDTHLLHATEVPANGAVTVDALSQLAAPNRPNYIGFRDCFIGLMYYNSGGNLGVLAGQSSQLNAVVDLQDRNTELSYQMLLANTTDRSRYFSMWNQAMDTYDPEVRVIDNIGVEDEMPNYCFPMSGVAFGAPMTKVQKNQNAWQAVANGGNMYVSRGNLGAMEINLSANLWRSFLYSNVALYLPDDQKYTPTNVRLPANTNTYEYMNGRKPLQGFLDSYVNIGTRWSPDAMDNVNPFNHHRNAGLRYRSQLLGNGRYCDFHIQVPQKFFAVRNLLLLPGTYTYEWSFRKDVNMILQSTLGNDLRVDGASINITSVNLYASFFPMSHNTASTLEAMLRNDTNDQSFNDYLSAANMLYPIPPNATQLPISIPSRNWAAFRGWSFTRLKQRETPALGSAFDPYFTYSGTIPYLDGTFYLSHTFRRVAIQFDSSVTWPGNDRLLTPNEFEIKRTVDGEGYTVAQSNMTKDWFLVQMLAHYNMGFQGYQLPPDYKDRTFSFLHNFTPMCRQVPNPANEGHQQLRITRLHNNSGFIGFDTGAGSREGHPYPANWPYPLIGPDAVPSVTQRKFLCDRTLWRIPFSSNFMSMGSLTDLGQNLLYANAAHALDMTFEVDPINEPTLLYVLFEVFDVARVHQPHRGVIEVVYLRTPFSAGNAT

SEQ ID NO: 35 - protein, 911 aa, Tree shrew adenovirus
MATPSMLPQWSFMHIAGQDASEYLSPGLVQFARATESYFNIGNKFRNPTVAPTHDVTTERSQRLQLRFVPVDKEDTQYTYKTRFQLAVGDNRVLDMGSTYFDIRGTLDRGPSFKPYSGTAYNSLAPKSATNNAQYTSGGKTATYAQASFISEIVEVGGQYGIKVGEDNTGADILADPNYQPEPTVGGEGWTVELGTIDSAGGRVLSATTPKAPCYGSYAAPTNNNGGQTTGQVNVKFFKEGQGAGNPTVALYSETVDMQSPDTHLVYATEPGALPDGLGQQSAPNRPNYIGFRDNFIGLMYYNSNGNLGVLAGQASQLNAVVDLQDRNTELSYQLMLDSLVDRSRYFSMWNQAVDSYDPDVRVLENNGVEDELPNYCFPLSGVGLTELYTGVARNGGNWAADNDAAASQIAVGNVHAMEINIAANLWRGFLYSNVALYLPDEYKYTPINVTLPENTNTYAYMNGRVPANNLVDSFVNVGARWSPDVMDNVNPFNHHRNAGLRYRSQLLGNGRYCRFHIQVPQKFFAIKNLLLLPGTYTYEWSFRKDVNMILQSTLGNDLRVDGASINIESVNLYASFFPMSHNTASTLEAMLRNDTNDQCFTDYLSAANMLYPIAANATNVPISIPSRNWAAFRGWSFTRLKQKETPALGSPYDPYFTYSGSIPYLDGTFYLNHTFRRVAIQFDSSVSWPGNDRLLTPNEFEIKRAVDGEGYSTAQSTITKDWFLTQMLANYNIGYQGYYLPDGYKDRLYSFLRNFQPMCRQVVDEANYANYKAVSITHQHNNSGFTGFASAAVPREGHPYPANWPYPLIGDTAVPSVTQRKFLCDRTLWRIPFSSNFMSMGTLSDLGQNLLYANSAHALDMIFEVDPMPEPTLLYVLFEVFDVARVHQPHRGVIEVVYLRTPFSAGNATT

SEQ ID NO: 36 - protein, 905 aa, Canine adenovirus 2
MATPSMLPQWSYMHIAGQDAAEYLSPALVQFAQATSSYFKLDNKFRNPTVAPTHDVTTERSQRLQLRFVPVMQEDGQYTYKTRFQLAVGDNRVLDMASTYFDIRGTLDRGPSFKPYSGTAYNALAPKAGANNCLFNGQGANINTLAQVPSAGAITVNGQAAVTNNTYQPEPQLGPESWVDGSLAELGDASGRALKASTPRMPCYGSYAPPTNENGGQATGPVESRFYKVTTNNNNEADAMLYTEDVNLQAPDTHLVHQVPEGQVTGVQGLGQQAAPNRPNYIGFRDNFIGLMYYNSNGNLGVLAGQSSQLNAVVDLQDRNTELSYQLLLDALTDRSRYFSMWNQAVDSYDQDVRIIDNHGVEDDMPNYCYPLSGMGPLTNMTTMKVNNQNFQAENTNVGPIQKIGFGNVEAMEINLNANLFKSFLYSNVALYLPDAFKYTPENIVAPANVNTYAYMNVRLPAANLIDTFVNIGARWSPDVMDTVNPFNHHRNAGLRYRSQLLGNGRYCSFHIQVPQKFFAIKNLLLLPGTYTYEWSFRKDVNMILQSSLGNDLRVDGATINIQSINLYASFFPMAHNTASTLEAMLRNDVNDQSFADYLSSANMLYPIPANTTNLPISIPARNWAGFRGWSFTRIKQRETPALGSPYDPYFTYSGSIPYLDATFYLSHTFRRVSIMFDSSVSWPGNDRLLTPNEFEIKRYVDGEGYNVAQSNMTKDWFMVQMLAHYNIGYQGYHLPESYKDRMYSFLRNFEPMCRQLVDVANYAAYQPVTVGHQHNNSGYASALSAFNPREGHPYPANWPYPLIGANAVPTVTQKKFLCDRSLWRIPFSSNFMSMGTLTDLGQNLLYSNSAHALDMTFEVDAMNEPTLLYVLFEVFDVARVHQPHRGVIEVGYLRTPFSAGNATT

SEQ ID NO: 37 - protein, 905 aa, Canine adenovirus 1
MATPSMLPQWSYMHIAGQDAAEYLSPALVQFAQATSSYFKLDNKFRNPTVAPTHDVTTERSQRLQLRFVPVMQEDGQYTYKTRFQLAVGDNRVLDMASTYFDIRGTLDRGPSFKPYSGTAYNALAPRAGANNCLFNGSGANINTLAQVPFAGAITVNGQAAVTDNTYQPEPQLGPESWVDGTLADLGDASGRALKASTPRMPCYGSYAPPTNENGGQATGAVERRFYKVTTNNNNEADALLYTEDVNLQTPDTHLVHQVSDDQVTGVQGLGQQAAPNRPNYIGFRDNFIGLMYYNSNGNLGVLAGQSSQLNAVVDLQDRNTELSYQLLLDALTDRSRYFSMWNQAVDSYDQDVRIIDNHGVEDDMPNYCFPLSGMGPLTNMTAMKVNNQNFQTDNTNVGPIQKIGFGNVEAMEINLNANLFKGFLYSNVALYLPDAYKYTPDNIVAPANANTYAYMNVRLPAANLIDTFVNIGARWSPDVMDSVNPFNHHRNAGLRYRSQLLGNGRYCSFHIQVPQKFFAIKNLLLLPGTYTYEWSFRKDVNMILQSSLGNDLRVDGASINIQSINLYASFFPMAHNTASTLEAMLRNDVNDQSFADYLSAANMLYPIPANTTNLPISIPARNWAGFRGWSFTRIKQRETPALGSPYDPYFTYSGSIPYLDSTFYLSHTFRRVSIMFDSSVSWPGNDRLLTPNEFEIKRYVDGEGYNVAQSNMTKDWFLVQMLAHYNIGYQGYHLPESYKDRMYSFLRNFEPMCRQLVDVTNYATYQSVTVGHQHNNSGYASALSTFNPREGHPYPANWPYPLIGVNAVPTVTQKKFLCDRTLWRIPFSSNFMSMGTLTDLGQNLLYSNSAHALDMTFEVDAMNEPTLLYVLFEVFDVARVHQPHRGVIEVVYLRTPFSAGNATT

SEQ ID NO: 38 - protein, 908 aa, Bat adenovirus TJM
MATPSMLPQWSYMHIAGQDAAEYLSPALVQFAQATSSYFKLDNKFRNPTVAPTHDVTTERSQRLQLRYVPVMQEDGQYTYKTRFQLAVGDNRVLDMASTYFDIRGTLDRGPSFKPYSGTAYNPLAPKAGANNCLFNGTGNNINTVAQVTTLGNITVQGLNGVTNSAYEPYPQQGPESWTSGSLEAIGDAGARALKATVPRQPCYGSYAAPTNENGGQSTGTITPAYYKKTTTAGATDVDAMLYTEEVALQAPDTHLVYKVAEADAKGIPGVGQQAAPNRPNYIAFRDNFVGLMYYNSNGNLGVLAGQSSQLNAVVDLQDRNTELSYQLLLDALTDRTRYFSMWNQAVDSYDHDVRIIDNHGVEDDMPNYCFPLSGMGVMEAVSSMKVNTANNGFEANNTNQGPVQQIGFGNVNAMEINLNANLFKGFLYSNIALYLPDDYKYTPQNVTEPANHNTYAYMNIRLPAANLVDTFVNVGARWSPDVMDTVNPFNHHRNAGLRYRSQLLGNGRYCSFHIQVPQKFFAIKNLLLLPGTYTYEWSFRKDVNMILQSSLGNDLRVDGASITIQSINLYASFFPMAHNTASTLEAMLRNDVNDQTFADYLSAANMLYPIPANTTNLPISIPARNWAGFRGWSFTRIKQKETPALGSPFDPYFTYSGTMPYLDGTFYLSHTFRRVSIMFDSSVSWPGNDRLLTPNEFEIKRTVDGEGYNVAQSNMTKDWFLVQMLAHYNIGYQGYHLPESYKDRMYSFLRNFEPMCRQQVDTQKAENYQAVTINNQHNNSGYASALSASNPREGHPYPANWPYPLIGATALPSVTQKKFLCDRTLWRIPFSSNFMSMGTLTDLGQNLLYSNSAHALDMTFEVDEMNEPTLLYVLFEVFDVARVHQPHRGVIEVVYLRTPFSAGNATT

SEQ ID NO: 39 - protein, 939 aa, Porcine adenovirus 3
MATPSMMPQWSYMHISGQDASEYLSPGLVQFSQATETYFNLNNKFRNPTVAPTHDVTTERSQRLQLRFVPVDKEDTQYTYKTRFQLAVGDNRVLDMASTFFDIRGTLDRGPSFKPYSGTAYNIMAPKSAPNNCQYLDPKGETEAGKVNTIAQASFVGPIDETTGDIKITEEEDEETTIDPLYEPQPQLGPSSWSDNIPSATSGAGRVLKQTTPRQPCYGSYASPTNIHGGQTKDDKVTPLYFTNNPATEAEALEENGLKPNVTLYSEDVDLKAPDTHLVYAVNQTQEFAQYGLGQQAAPNRANYIGFRDNFIGLLYYNSNGNQGMLAGQASQLNAVVDLQDRNHRTSYQLFLDSLYDRSRYFSLWNQGIDSYDKDVRVLGNNGVEDEMPNFCFPIGAIETNMTFTQLKKSENGGSRATTWTKENGDDGGNGAEHYLGIGNLNAMEINLTANLWRSFLYSNVALYLPDKYKFSPPNVPIDPNTHSYDYINKRLPLNNLIDTFVNIGARWSPDVMDNVNPFNHHRNYGLRYRSQLLGNGRYCKFHIQVPQKFFALKSLLLLPGATYTYEWSFRKDVNMILQSTLGNDLRADGAKINIESVNLYASFFPMAHNTASTLEAMLRNDTNNQTFIDFLSSANMLYPIPANVTNLPISIPSRNWAAFRGWSFTRLKHNETPALGSPFDPYFTYSGSIPYLDGTFYLGHTFRRISIQFDSSVAWPGNDRLLTPNEFEVKRTVDGEGYTVAQTNMTKDWFLVQMLAHYNIGYQGYHLPEGYRDRTYSFLRNFEPMCRQVPDYANHKDEYLEVPTTNQFNSSGFVSAAFTAGIAQGHPYPANWPYPLIGEDAVQTVTQRKFLCDRTLWRIPFSSNFMSMGTLTDLGQNLLYANSAHALDMTFEVDAMDEPTLLYVLFEVFDVCGVHQPHRGVIEAVYLRTPFSAGNATT

SEQ ID NO: 40 - protein, 938 aa, Porcine adenovirus 3
MATPSMMPQWSYMHISGQDASEYLSPGLVQFSQATETYFNLNNKFRNPTVAPTHDVTTERSQRLQLRFVPVDKEDTQYTYKTRFQLAVGDNRVLDMASTFFDIRGTLDRGPSFKPYSGTAYNIMAPKSAPNNCQYLDPKGETEAGKVNTIAQASFVGPIDETTGDIKITEEEDEETTIDPLYEPQPQLGPSSWSDNIPSATSGAGRVLKQTTPRQPCYGSYASPTNIHGGQTKDDKVTPLYFTNNPATEAEALEENGLKPNVTLYSEDVDLKAPDTHLVYAVNQTQEFAQYGLGQQAAPNRANYIGFRDNFIGLLYYNSNGNQGMLAGQASQLNAVVDLQDRNTELSYQLFLDSLYDRSRYFSLWNQAIDSYDKDVRVLENNGVEDEMPNFCFPIGAIETNMTFTQLKKSENGGSRATTWTKENGDDGGNGAEHYLGIGNLNAMEINLTANLWRSFLYSNVALYLPDKYKFSPPNVPIDPNTHSYDYINKRLPLNNLIDTFVNIGARWSPDVMDNVNPFNHHRNYGLRYRSQLLGNGRYCKFHIQVPQKFFALKSLLLLPGTYTYEWSFRKDVNMILQSTLGNDLRADGAKINIESVNLYASFFPMAHNTASTLEAMLRNDTNNQTFIDFLSSANMLYPIPANVTNLPISIPSRNWAAFRGWSFTRLKHNETPALGSPFDPYFTYSGSIPYLDGTFYLGHTFRRISIQFDSSVAWPGNDRLLTPNEFEVKRTVDGEGYTVAQTNMTKDWFLVQMLAHYNIGYQGYHLPEGYRDRTYSFLRNFEPMCRQVPDYANHKDEYLEVPTTNQFNSSGFVSAAFTAGMREGHPYPANWPYPLIGEDAVQTVTQRKFLCDRTLWRIPFSSNFMSMGTLTDLGQNLLYANSAHALDMTFEVDAMDEPTLLYVLFEVFDVCGVHQPHRGVIEAVYLRTPFSAGNATT

SEQ ID NO: 41 - protein, 914 aa, Bovine adenovirus 10
MATPSMMPQWSYMHIAGQDASEYLSAGLVQFARATDSYFSLGNKFRNPTVAPTHDVTTERSQRLQLRFVPVDKEDTQYTYKTRFQLTVGDNRVLDMGSTYFDIRGVIDRGPSFKPYSGTAYNNLAPRSAPNNCFFKNDNGGHPDVAYAQLPFVGTREQQNLMVLNAEGQRVAADPIYQPEPQYGVDAWPQNRLGDFNAGRALKSDVTHLPCYGSYASPTNIHGGQSTDDDITKVFFRRENAAGAPEGVLYSETVALEQPDTHLSFKVTADQTTKLLGLAQQACPNRPNYIGFRDNFIGLMYYNSNGNLGVLAGQASQLNSVVDLQDRNTELSYQLMLDNLYDRSTYFSLWNQAIDSYDPDVRIIENHGVEDEIPAFCFPISAIQTTVFYTQMKTDDNGNNWTPVDNATQNQYVDRGNLQCMEVNISGNLWRSFLYSNVGLYLPDRLKFTPENVEEPENHDTYDYMNIRIPPSGLVENYINIGARWSLDIMDNVNPFNHHRNAGLRYRSQLLGNGRYCEFHIQVPQKFFAIKNLLLLPGTYNYEWSFRKDVNMIFQSSLGNDLRVDGAKITIESVNLYASFFPMAHNTASTLEAMLRNETNDQTFNDYLSAANMLYPIPPQTSNVPITIPSRNWAAFRGWSFTRLKAKETPALGSPYDPYFTYSGSIPYLDGTFYLNHTFRKVAIQFDSSVSWPGNDRLLSPNEFEIKRQVDGEGYNIAQSNMTKDWFLTQMLCHYNIGYQGYHLPDSYKDRTYSFLKNFQPMCRQIVTANTFDNYKAVTIANQHNNSGFIGFPNPVSAREGHPYPANWPYPIIGTTAHRAETQRKFLCDRTLWRIPFSSNFMSMGSLTDLGQNLLYSNSAHALDMTFEVEPMDEPTLLYVLFEVFDVCRIHQPHRGVIETVYLRTPFAAGNATT

SEQ ID NO: 42 - protein, 908 aa, Ovine adenovirus 1
MATPSMMPQWSYMHIAGQDASEYLSPGLVQFAQATETYFKLGNKFRNPTVAPTHDVTTERSQRLQLRFVPVDREDTQYSYKTRFQLAVGDNRVLDMASTYFDIRGTLDRGPSFKPYSGTAYNPLAPKASVNNTFFTAAANNNAQAIAQAPFVAEIVANTGEIEIDGEPIDNTYQPEPQLGEESWLSGTINPINEATGRILNTNTDPLPCYGSYANPTNKDGGQATGNKLTVNFKLGNQAGDPDTAFIMEDVNLTAPDSHLVYKVPQDQAGKIAAVAQQAGPNRPNYIGFRDNFIGLMYYNSNGNLGVLAGQASQLNAVVDLQDRNTELSYQLMLDSLYDRSRYFSIWNQAVDSYDPDVRIIENHGVEDEMPNYCFPISGIFPGSPSVRVTRQQNAWAKAPGTEDNNYINKGNLECMEINLNANLWRGFLYSNVALYLPDALKFTPPNVTLPQNQNTYAYMNGRIPAGGLVDTFVNIGARWSLDVMDNINPFNHHRNAGLRYRSQLLGNGRYCQFHIQVPQKFFAIKNLLLLPGTYTYEWSFRKDVNMVLQSTLGNDLRVDGASITIDSVNLYASFFPMAHNTASTLEAMLRNDTNDQSFIEYLSSANMLYPIPANATNLPISIPSRNWAAFRGWSFTRIKQKETPALGSPFDPYFTYSGTIPYLDGTFYLNHTFRRVSIQFDSSVQWPGNDRLLTPNEFEIKRMVDGEGYNVAQSNMTKDWFLVQMLANYNIGYQGYHLPDSYKDRTYSFLRNFEPMSRQVVDIANYAAYQDVPLTHQHNNSGFTGFGSAALPREGHPYPANWPYPLIGANAAPTLTQRKFLCDRTLWRIPFSSNFMSMGSLTDLGQNLLYANAAHALDMTFEVDAMDEPTLLYVLFEVFDVVRVHQPHRGVIETVYLRTPFSAGNAT

SEQ ID NO: 43 - protein, 908 aa, Bovine adenovirus 1
MATPSMMPQWSYMHIAGQDASEYLSPGLVQFAQATETYFKLGNKFRNPTVAPTHDVTTERSQRLQLRFVPVDREDTQYTHKTRFQLAVGDNRVLDMASTYFDIRGTLDRGPSFKPYSGTAYNALAPKGSINNTFVSVAGNNNAKAFAQAPQSATVDGTTGAIQIDGAAIDNTYQPEPQKGEESWLSGTVNPIAQATGRILNTSTDPLPCYGSYAAPTNIEGAQTLNNNLIQVNFVAGGAPGAPDVGMIMEDVALQTPDTHLVYKVPAANVGNTAALAQQAAPNRANYIGFRDNFIGLMYYNSNGNLGVLAGQASQLNAVVDLQDRNTELSYQLMLDNLYDRSRYFSIWNQAVDSYDPDVRIIENHGVEDELPNYCFPISGIVPGTTSTRVTRNGGNWEATANNDPAYVNKGNLDCMEINLAANLWRGFLYSNVALYLPDDLKFTPPNVTLPNNTNTYAYMNGRVPAAGLVDTYVNIGARWSLDVMDNVNPFNHHRNAGLRYRSQLLGNGRYCHFHIQVPQKFFAIKNLLLLPGTYTYEWSFRKDVNMVLQSTLGNDLRVDGASITIESVNLYASFFPMAHNTASTLEAMLRNDTNDQSFIDYLSSANMLYPIPANATNLPISIPSRNWAAFRGWSFTRIKQKETPALGSPFDPYFTYSGTIPYLDGTFYLNHTFRRVSIQFDSSVQWPGNDRLLTPNEFEIKRLVDGEGYNVAQSNMTKDWFLVQMLANYNIGYQGYHLPDGYKDRTYSFLRNFQPMTRQIVDQTNVPAYQNVPITHQHNNSGFTGFASPALPREGHPYPANWPYPLISATAVATQTQRKFLCDRTLWRIPFSSNFMSMGSLTDLGQNLLYANAAHALDMTFEVDAMDEPTLLYVLFEVFDVVRVHQPHRGVIETVYLRTPFSAGNAT

SEQ ID NO: 44 - protein, 910 aa, Ovine adenovirus 2
MATPSMMPQWSYMHIAGQDASEYLSPGLVQFAQATESYFKLGNKFRNPTVAPTHDVTTERSQRLQLRFVPVDREDTQYTYKTRFQLAVGDNRVLDMGSTYFDIRGTLDRGPSFKPYSGTAYNCLAPKASVNNTLFIATTGAKPQAIAQASFEATVNDNTGAIELDGQQINLSYQPSPQLGEESWLGDDFNPIKEGTGRILDVNTKPLPCYGSYAPPTNINGGQGLAEPTTINFKTGNAPDIPDTGFALENVALQAPDTHLVYKVANDKSGKTAALGQQAAPNRPNYIGFRDNFIGLMYYNSNGNLGVLAGQASQLNAVVDLQDRNTELSYQLMLDSLYDRSRYFSMWNQAIDSYDPDVRIIENHGVEDEMPNYCFPISGIKLEETSMRVVRNPGNNGWIGDNDANGNNYINIGNMDCMEINLSANLWKGFLYSNIALYLPDDYKFTPANVTLPENTNTYEYLNGRIPAGGLVDTYVNIGARWSLDVMDTVNPFNHHRNAGLRYRSQLLGNGRYCQFHIQVPQKFFALKNLLLLPGTYTYEWSFRKDVNMILQSTLGNDLRVDGASITIDSVNLYASFFPMAHNTASTLEAMLRNDTNDQSFIDYLSSANMLYPIPAKATNIPITIPSRNWAAFRGWSFTRIKQKETPALGSPFDPYFTYSGTIPYLDGTFYLSHTFKRVSIQFDSSVQWPGNDRLLTPNEFEIKRVVDGEGYGVAQSNMTKDWFLVQMLANYNIGYQGYHLPDGYKDRTYSFLRNFQPMCRQMVDSTRYQACQEVTISNQHNNSGFTAFANASLPREGHPYPANWPYPLIGENVAPCTTQKKFLCDKTLWRIPFSSNFMSMGSLTDLGQNLLYANAAHALDMTFEVDAMDEPTLLYVLFEVFDVVRVHQPHRGVIETVYLRTPFSAGNAT

SEQ ID NO: 45 - protein, 909 aa, Ovine adenovirus 3
MATPSMMPQWSYMHIAGQDASEYLSPGLVQFAQATESYFKLGNKFRNPTVAPTHDVTTERSQRLQLRFVPVDREDTQYTYKTRFQLAVGDNRVLDMGSTYFDIRGTLDRGPSFKPYSGTAYNCLAPKASVNNTLIISNDANKPQAIGQASYDCEINDDTGAIEIGGQNPTDLAYQPNPQIGQETWVFDNFGKMTQGAGRMLNTDTKPLPCYGSYAPPTNVNGGQGLAQPTTINFASGDQADTPDTGFALENVNLQAPDTHLVYKVAADKVGKTAALGQQAAPNRPNYIAFRDNFIGLMYYNSNGNLGVLAGQASQLNAVVDLQDRNTELSYQLMLDSLHDRSRYFSMWNQAIDSYDTDVRIMENHGVEDEMPNYCFPVSGIQTLSTATKVKKGAADWETDTDANGVNYITLGNLNCMEINLSANLWKGFLYSNIALYLPDEFKFTPENVDLPENKNTYAYMNGRLPAGGLIDTYVNIGARWSPDVMDVVNPFNHHRNAGLRYRSQLLGNGRYCQFHIQVPQKFFALKNLLLLPGTYTYEWSFRKDVNMILQSTLGNDLRVDGASINIDSVNLYASFFPMAHNTASTLEAMLRNDTNDQSFIEYLSSANMLYPIPAKATNIPITIPSRNWAAFRGWSFTRLKQKETPALGSPFDPYFTYSGTIPYLDGTFYLSHTFKRVSIQFDSSVQWPGNDRLLTPNEFEIKRAVDGEGYSVAQSNMTKDWFLVQMLANYNIGYQGYHLPDGYKDRTYSFLRNFQPMCRQIVDSTRYDAYKEVTISNQHNNSGFTAFANSSLPGEGHPYPANWPYPLIGENVAPCTTQKKFLCDRTLWRIPFSSNFMSMGSLTDLGQNLLYANAAHALDMTFEVDAMDEPTLLYVLFEVFDVVRVHQPHRGVIETVYLRTPFSAGNAT

SEQ ID NO: 46 - protein, 910 aa, Bovine adenovirus 2
MATPSMMPQWSYMHIAGQDASEYLSPGLVQFAQATESYFKLGNKFRNPTVAPTHDVTTERSQRLQLRFVPVDREDTQYTYKTRFQLAVGDNRVLDMGSTYFDIRGTLDRGPSFKPYSGTAYNCLAPKASVNNTLIISNDANKPQAIGQASYDCAINDDTGAIEIGGPNPTDLAYQPNPQIGQETWVFDNFGKMTQGAGRMLNTDTKPLPCYGSYAPPTNVNGGQGLAQPTTINFVSGDQADTPDTGFALENVNLQAPDTHLVYKVAADKVGKTAALGQQAAPNRPNYIAFRDNFIGLMYYNSNGNLGVLAGQASQLNAVVDLQDRNTELSYQLMLDSLHDRSRYFSMWNQAIDSYDTDVRIMENHGVEDEMPNYCFPVSGIQTLSKATKVKKGVANWETDTDANGVNYITLGNLNCMEINLSANLWKGFLYSNIALYLPDEFKFTPENVDLPENKNTYAYMNGRLPAGGLIDTYVNIGARWSPDVNGRCKPIYHHRNAGLRYRSQLLGNGRYCQFHIQVPQKFFALKNLLLLPGTYTYEWSFRKDVNMILQSTLGNDLRVDGASIKIDSVNLYASFFPMAHNTASTLEAMLRNDTNDQSFIEYLSSANMLYPIPAKATNIPITIPSRNWAAFRGWSFTRLKQKETPALGSPFDPYFTYSGTIPYLDGTFYLSHTFKRVSIQFDSSVQWPGNDRLLTPNEFEIKRAVDGEGYSVAQSNMTKDWFLVQMLANYNIGYQGYHLPDGYKDRTYSFLRNFQPMCRQIVDATRYNDYKEVTISNQHNNSGFTAFANASLPREGHPYPANWPYPLIGENVAPCATQKKFLCDRTLWRIPFSSNFMSMGSFTDLGQNLLYANAAHALDMTFEVDAMDEPTLLYVLFEVFDVVRVHQPHRGVIETVYLRTPFSAGNATT

SEQ ID NO: 47 - protein, 920 aa, Alpaca adenovirus CA/2007
MATPSMMPQWSYMHIAGQDASEYLSPGLVQFAQATETYFKLGNKFRNPTVAPTHDVTTERSQRLQLRFVPVDKEDTQYTYKTRFQLAVGDNRLLDMGSSYFDIRGRLDRGPSFKPYSGTAYNSLAPKSSVNNCGFTSAADLPQYIAQASFINDINTNTGEMQVGENDQGQPVYADKTYQPEPQIGNQSWSQGPQNTLLADIEGAGRALKPTTPRNPCYGSYAAPTNENGAQATGEVDLVFLTQGNTAGPPTSVLYTEDVALTAPDTHFVYKVADDDLATAPGLGQQAAPNRPNYIGFRDNFIGLMYYNSNGNLGVLAGQASQLNAVVDLQDRNTELSYQLMLDNLYDRSRYFSIWNQAIDSYDQDVRVLENHGVEDELPNYCFPLSGVLYTTPTSMQVVRGADQNDGWIANNAGSGINYINNGNLDCMEINLAANLWRGFLYSNIALYLPDNLKFTPNNVILSNNPNTYNYMNGRIPAAGLVDSFVNIGARWSPDVMDSVNPFNHHRNAGLRYRSQLLGNGRYCSFHIQVPQKFFAIRNLLLLPGTYTYEWSFRKDVNMILQSTLGNDLRVDGASIIIDSVNLYASFFPMAHNTASTLEAMLRNDTNDQSFIDYLSAANMLYPIPAGATNIPISIPSRNWAAFRGWSFTRIKQKETPALGSAYDPYFTYSGTIPYLDGTFYLNHTFRRLAIQFDSSVSWPGNDRLLTPNEFEIKRVVDGEGYNVAQSNMSKDWFLIQMLTNYNIGYQGFYLPEGFRDRTYSFLRNFQPMCRQVVDTDNFADYKPVQLQHQHNNSGFTGFAAASAAREGHPYPANWPYPLIGENAVRTTTQKKFLCDRTLWSIPFSSNFMSMGSLTDLGQNLLYANAAHALDMTFEVDALDEATLLYVLFQVFDVCRVHQPHRGVIEVVYLRTPFSAGNAT

SEQ ID NO: 48 - protein, 909 aa, Murine adenovirus 1
MTTPSMQPQWAFMHIAGQDASQYLSPGVVQFAAATDTYFSLGNKFRNPTVAPTHDVTTDRSQRLTLRIVPVDREDSQYTYKTRFQLSVGDNRVLDMASTYFDIRGRLDRGPSFKPYSGTAYNSLAPRAAPNNLMFKTGADSKTMTIAQANIVGSTIDQDGLKINNVALNPNAGEPAVQEGLENWMEELQIGADKKFASRVLKADQPVLPNYGSYAYPTNINGTQTKDGTTVDKVYMCSKGANVQNPDVVLYSEEVNLQAPDTHLLDGPGADNPKDRVAFCAAPNRPNYIGFRDNFIGLMYYNSNGNQGVLAGQASQLNAVVDLQDRNTELSYQFLLDSLYDRSRYFSLWNQAIDSYDPRVRIIENDGVEDDITSFAFDLRGIGDLPYKQVQTHNGNQQSANTTDTCYIGKGNMAAMEINIPANLWLGFLYANVAQYMPDDFKVDPSNIQMPQDKTTYAYMNQRIAPAGLIETYVNVGGRWSVDFMDTVNPFNHHRNEGLKYRSQILGNGRFVDFHIQVPQKFFAIKSLLLLPGSYTYEWSFRKDVNMVLQSSLGNDLRADGARLEIHSVNLYASFFPMAHNTASTLEAMLRNETNDQTFLDYLSSATMMFPIPAGQTQVPVSIPARNWAAFRGWSFTRIKQQETPNIGSPYDPYFKYSGSIPFLDATFYLTHTFQRVSIMFDSSVSWPGNDRLLTPNEFEIKRHIDAEGLCVGQSNMTKDWFLVQMLSNYNIGYQGFYLPENNKDRTYSFVRNFEPLARQVVDDAAAANYRDVPLSKRFNNSGWRSAGPPIFAREGAPYPANWPYPLCGEAAWAAKTQRKFLVDRYMYRIPFSSNFMSMGALTDLGQNLLYANSAHSLEMTFNVDPMQEATFLYILFEVFDCVRIHQPHRGIIEAVYLRSPFSAGNATT

SEQ ID NO: 49 - protein, 909 aa, Murine adenovirus 3
MTTPSMQPQWAFMHIAGQDASQYLSPGVMQFAAATETYFSLGNKFRNPTVAPTHDVTTDRSQRLTLRIVPVDREDSQYTYKTRFQLSVGDNRVLDMASTYFDIRGRLDRGPSFKPYSGTAYNSLAPRAAPNNLMYQVGGNNPKTKTIAQANIPGTQIDANGLQVNNQNLDIQRGEPEVQVGYQNWMDELEPGNQPKYAGRVLKTNQPVLPNYGSYAFPTNENGTQTKNGTQVDKVFMLPKVNAQNADVVLYSEEVNLQAPDTHLLEGPSAATATNRVAIQAAPNRPNYIGFRDNFIGLMYYNSNGNQGVLAGQASQLNAVVDLQDRNTELSYQFLLDSLYDRSRYFSLWNQAIDSYDPRVRIIENDGVEDDITSFAFDLRGVGRLEYKQVQTHQGNQQANNADDTSYIGKGNMAAMEINIPANMWIGFLYANVAQYVPDAYKVDPTNIAMPENKNTYSYMNQRIAPTGLVETYVNMGGRWSVDFMDTVNPFNHHRNDGLKYRSQVLGNGRYVDFHIQVPQKFFAIKNLLLLPGSYTYEWSFRKDVNMVLQSTLGNDLRADGASLEIHSVNLYASFFPMAHNTASTLEAMLRNETNDQTFLEYLSSATMMFPIPAGQTQIPVSIPARNWAAFRGWSFTRLKQSETPNIGSPFDPYFTYSGSIPFLDATFYLTHTFQRVSIMFDSSVSWPGNDRLLTPNEFEIKRNIDGEGLCVAQSNMTKDWFLVQMLANYNIGYQGYHLPDNNKDRTYSFLRNFEPMTRQVVDRQLDGRYVDVMLTKRFNNSGWKSASAPIFPREGAPYPANWPYPLCGEMAWATRTQRKFLVDRYMYRIPFSSNFMSMGALTDLGQNLLYANSAHSLEMTFEVDPMTEATYLYILFEVFDCVRIHQPHRGIIEAVYLRTPFSAGNATT

SEQ ID NO: 50 - protein, 910 aa, Bovine adenovirus 4
MEPQREFFHIAGRNAREYLSENLVQFITATQSFFNLGEKFRDPFVAPTSGVTTDRSQKLQLRIVPIQVEDNENFFKARFTLNVGDNRIADLGSAFFDIEGFIDRGPSFKPYGGTAYNPLAPKSALPNMAFKNNEETTYIAQLPQIYAAEDKGLETSQLVFLFPATKPNPQEGRSDEGIIMALMILDTKKFGAYGRLIGADSQGKIFPAYGSYVKPVSVEGSVSTADVQRVYLNTTDVNDRVSGVLAVDTVQRLNPDCHYAEYTNEVKITSSGNRPNYIGFRDNFVGLMYYNNGSNAGTFPSQTQQLNVVLDLNDRNSELSYQYLIAEISSRYKHFALWNQAVDTYDENVRIIHNEGYEEGPPVLSFPPFGIQNFFSDTDEGTAMTIQEGNQQAQKLTIQSLWLWNIPTLEMNLAANLQRTFLWANVAMYLPDNLKRTPPNVDLPANKNTYGYMNGRIPYPNVIDTWTNIGARWSLDIMDTINPFNHHRNTGLKYRSQLLGNGRFSRFHIQVPQKFFAIKNLLLLPGTYNYEWYFRKDPNMIFQSSIGNDLRADGAYINYSNINLYVSFFPMNYDTVSELELMLRNATNDQNFADYLGAVNNLYQIPPNTSTVVVNVPDRSWGAFRGWSFNRVKASETPMIGATKDPNFLYSGSIPYLDGTFYLTHTFQRVSIQWDSSVPWPGDDRLLIPNWFEIKRDYSIDAEATNMSQCNITKDWYMIQMAANYNQAYQGYKLPISHKYYGFLENFQPMSRQVPIYGGDLYDLYTEYIKNPNLMQIWNNCGLQQKTSGIPLLENSGHLYVANWPYPLIGKHAIESQKLQKFLCDKYMWQIPFSSNFLNMGNLTDLGQNVLYANASHSLNMVFTVDPMQETTYLMLLFGVFDQVVINQPTRSGISVAYLRLPFSAGSATT

SEQ ID NO: 51 - protein, 903 aa, Odocoileus adenovirus 1
MEPQREFFHIAGRNAREYLSENLVQFITATQSFFNLGEKFRDPFVAPSSGVTTDRSQKLQLRIVPIQTEDNENFYKARFTLNVGDNRVADLGSAYFDIEGTLDRGPSFKPYGGTAYNPLAPKSAMPNITVTKGGDTIYIAQLPQTYAANDKGVPEAIAVQTTAIKPNPQSGQTEDFAGVDKVDPTTTGGQGRILSATSVGDVFPAYGSYAPPQSVTGDISTEAVTRVYLNTTTTEDRVSGITAVDKAIRKHPDAHFVEFVEDGKATSSGNRPNYIGFRDNFIGIMFYNNGSNAGTLSSQTQQLNVVLDLNDRNSELSYQYLLADISNRYKYFALWNQAVDNYDEYVRILHNEGYEEGPPVLSFPPNGVQNYFTPPAKGNAMTVDTGRNTAAKTDNTKAFIGYGNIPSLEMNLSANLQRTFLWANVAMYLPDKYKKTPNNVDLPANTNSYGYINGRIPIPNVIDTWTNIGARWSLDVMDNVNPFNHHRNNGLKYRSQLLGNGRYCKFHIQVPQKFFAIRNLLLLPGTYNYEWYFRKDPNIVLQSSIGNDLRADGAIITYTSINLYVSFFPMNYETVSELELMLRNATNDQNFADFLGAVNNLYQIPANTNTIVVNIPDRSWGAFRGWSFNRIKATETPMIGATKDPNFNYSGSIPYLDGTFYLTHTFQRVSIQWDSSVPWPGDDRLLIPNWFEIKREPNYDPEGYNISQSTLTKDFFMVQMAANYNQAYQGYKLPSTYKHYGFIENFEPMSRQVPVYGDDVFDLYNAYLQDPTNMQIWNNCGLQQKTTNISLLENSGHLYVANWPYPLVGRDAVENQTTEKKFLCDKYMWQIPFSSNFLNMGNLTDLGQNVLYANSSHSLNMVFTVDSMPENTYLMLLFGVFDQVVVNQPTRSGISVAYLRLPF

SEQ ID NO: 52 - protein, 902 aa, Goat adenovirus 1
PQRDFFHIAGRNAREYLSENLVQFISATQSFFNLGEKFRDPFVAPSTGVTTDRSQKLQLRIVPIQTEDNENFYKTRFTLNVGDNRVADLGSAYFDIEGVIDRGPTFKPYGGTAYNPLAPKSAFPNAAFMDNDEATTVYIAQLPNAYKAQNKGVEEAIRVEANTTTPNPQSGDYATYDTAKFNPETTGASGRLLSINSLGDLFPAYGSYCRPQSADGNISTAPITKVYLNTTATDDRVSGVTAVDTATRLHPDAHYIEYTDEAKATAIGNRPNYIGFRDNFIGLMFYNNGSNAGTFSSQTQQLNVVLDLNDRNSELSYQYLIADLTDRYRYFALWNQAVDSYDSHVRILHNEGYEEGPPALSFPSQGIQNYFMPTAAGNAMTVDTGRNTAAKTDNTKAFIGYGNIPSLEMNLTANLQRTFLWSNVAMYLPDRLKTTPPNINLPEDTNSYGYMNGRVPLANIIDTWTNIGARWSLDVMDTVNPFNHHRNSGLKYRSQLLGNGRYCRFHIQVPQKFFAIKNLLLLPGTYNYEWYFRKDPNMVFQSTLGNDLRADGATITYTNINLYVSFFPMNYETVSELELMLRNATNDQNFADYLGAVTNLYQIPANTNTVVVNVPDRSWGAFRGWSFNRVKASETPMIGATKDPNFTYSGSIPLLDGTFYLTHTFQRVSIQWDSSVPWPGDDRLLVPNWFEIKRDPNMDAEGYTMSQSTITKDFYLVQMAANYNQAYQGYKMPIHSKYYGFLENFQPMSRQVPIYGNGTYDLYTAYVTNQRTMQIWNNSGLESKTSNPPILSNTGHLYVANWPYPLIGPNAIENQQTERKFLCDKYMWQIPFSSNFLNMGNLTDLGQSVLYTNSSHSLNMVFTVDSMPETTYLMLLFGVFDQVVINQPTRSGISVAYLRLPF

SEQ ID NO: 53 - protein, 907 aa, Possum adenovirus
MEPQREFFHIAGRNAREYLSENLVQFISATQTFFNLGDKFRDPFVAPSSGVTTDRSQKLQLRIVPIQTEDNESFYKARFTLNIGDNRVADLGSAYFDIEGILDRGPSFKPYGGTAYNPLAPKSALPNTAVTEGTTLKYYAQLPQLYSITDNGVNASTQQTVSSVIPDPQLGQYNYDEIDDADYTQKGGIGRVIGNDSTGDAYTAHGLYALPQSEQGNISTATIERVYVNSRVTNNAISGVMAVDTIERLHPDSHIVDYQDDAQVTTAGDRINYIGFRDNFIGLMYYNTGSNTGVFSSQTQQLNIVLDLNDRNSELSYQYLIADITDRYRYFALWNQAVDSYDPFVRVIENDGYEEGPPCFTFPLNGMQNPFSSPDSSTVVTNTGATAAGTGYIAYGNIPSMEMNLTANLQRTFLWANVAMYLPDRLKSSPANVDLPTNTQSYGYINSRIPLPNIIDTWTNIGAKWSLDVMDNINPFNHHRNMGLKYRSQLLGNGRYCKFRIQVPQKFFAIKNLLLLPGTYNYEWFFRKDPNMILQSTLGNDLRYDGASITYTAVNLYISFFPMNYDTVSELELMLRNSTNDQNFSDYLGAVNNLYQIPANTSTVVVNIPDRSWGAFRGWSFNRVKATETPMIGSTRDPNFTYSGTIPILDGTFYLSHTFQKVSIQWDSSVPWPGDDRMLIPNWFEVKRDTNSDPEGYCMSQTSITKDWYFVQMAASYNQGYQGYRLPSTNRYYGFIENFQPMSRQIPEYSTTDGLYDLYSYYVANPDSLPIWNNCGLQPPTAPPYNPMMRNAGHLYATNWPYPLTGKNAVSKQVTEKKFLCDKYMWQIPFSSNFLNMGNLTDLGQNVLYANSSHSLNMIFSVDAMDEPTYLFLLFGVFDQVVINQPTRSGISVAYMRLPFAAGSAAS

SEQ ID NO: 54 - protein, 910 aa, Duck adenovirus
MEPQREFFHIAGRNAKEYLSENLVQFITATQNYFNLGDKFRDPYVAPTNGVTTDRSQKLHLRIVPIQTEDNDSFFKARFTLNVGDNRIVDMGSSYFDIQGILDRGPSFKPYRGTAYNPLAPTSGMPNMAYTHSNNTTYIGQLPQIYSVTDKGVTEAKQQQIQSTDPNPQVGQSYGAGGPDDVDTEKSGGKGRLVVGTAGDSQVTGFPAYGSWCPPQSVTGDINTTLNPSTVYLNTTTDTDRVTGLVAGDTVEWNAPDAHYVNYVSDMQCSAAGNRPNYIGFRDNFIGIMYYNSGSNAGSFSSQTQQLNVVLDLNDRNSELSFQYLIAELTDRYKHFALWNQAVDSYDKFVRVIENDGYEEGPPSLSFPPHGFMNFFTAPDTGTAMTVSDDTATKTANTTAIFGYGNLPSMEINLTANLQRTFLWSNVAMYLPDYLKTTPPGVTLPANPNSYAYMNGRLPLPNIIDTWTNIGARWSLDVMDEINPFNHHRNLGLKYRSQLLGNGRYCKFHIQVPQKFFALRNLLLLSGTYNYEWYFRKDPNMILQSTLGNDLRADGASVTYTSINLYVAFFPLAYDTVSELELMLRNATNDQNFSDYLGAVNNLYQIPANSTSVVVNVPDRSWGAFRGWSFTRIKARETPAIGATKDPNFTYSGSIPLLDGTFYLSHTFNRVSIQWDSSVPWPGNDRLLTPNWFEIKRNVNADPEGYTMSQSSITKDWFMVQMAANYNQAYQGYSLPHTKFYDFLSNFEPMTRQIPDYSKYFDLYTQYLQDPKKMPIWNNSGVQQMTNSPALLENTGHLYMANWPYPLIGTAAVESQITESKFLCDRYMWMIPFSSNFLNMGTLTDLGQNVLYANSSHSLNMVFDVDPMAETTYLLLLFGVFDQVVINQPTRSGISVAYLRLPFAAGSAAT

SEQ ID NO: 55 - protein, 909 aa, Snake adenovirus
MEPQREFFHIAGRSAKEYLSENLVQFIQATQNYFNIGEKFRDPYVAPSAGVTTDRSQKLQLRVVPMQIEDNANYYKARFTLNVGDNRLVDLGSSYFDIKGTLDRGPSFKPYGGTAYNPLAPKSAPVNSPFIVGNDTHVVAQLPQTYAAANTGVTEAIQQQVSNVQPNPQDGLPNYSGPEVVDATTKAGLGRVVAEESEGQQFPCLRAYAAPQTAAGDVSTAPIEKTYVNTTNVAGRVSGTMATDVIDWQNPDAHFVDYVDDGRSTSAGNRPNYIGFRDNFIGIMYYNSGSNTGSLSSQTQQLNVVLDLNDRNSELSYQYMLADLTSRWHYFALWNQAVDSYDRHVRIIENDGYEEGPPNLSFPIQGIQNPFSPSSVGTEMTVNTANQTAAATANTVAHIGYGNIPAVEMNLPANLRRTFLYANVAMYLPDTYKFTPPNIDLPANHLSYGYMNGRLPLPNIIDTWTDIGARWSLDVMDTVNPFNHHRNTGLKYRSQLLGNGRHCNFHIQVPQKFFAIKNLLLLPGTYNYEWYFRKDPNMVLQSTLGNDLREDGAQITYNQVNLYVSFFPMNYDTQSELELMLRNATNDQNFSDYLGAVNNLYQIPAGSNTVVVNIPDRSWGAFRGWSFTRLKVTETPRIGATQDPNFEYSGTIPYLDGTFYLSHTFQRCSIQWDSSVPWPGNDRLLVPNWFEIKDPPNQDPEGYNTMQSNLTKDFFFTQMAASYNQGYQGFSYPSCTKHYGFINNFEPMSRQVPVYDATHPNLMAAYLNNPATMPIWNNCGFQQKTSTNALLERCGHAYVANWPFPLTGRDALPNQTTEKKFLVDNYLWQIPFSSNFLNMGTLTDLGQNVMYANSSHSLNMQFTVDPMNEPTYLLLLFGVFDQVVVNQPTRSGISVAYLRLPFASGSAAT

SEQ ID NO: 56 - protein, 906 aa, Turkey adenovirus 3
MDISNATPKLDIFHIAGPDASEYLSENLVNFISSTESYFPINKKFRETIVAPTKGVTTEQSQKLQVKIVPTLTQDLENSFTARFTIAVGDGRVLDMGSTYFDIRGNIDRGPSFKPYGGTAYNPLAPRSAQFNNIKTVGGKTYLTAQATKFFSTSGNGCAAANTEASSFTNLVPSPNTGSAESSFDPTTEGASCRAITLGSSVTDATCYGAYTPIQNANGSILPPSVTPDKKFADAGKSGSVTCTAAICCDNVTVQYPDTRIVAYDSTDKIATRMGNRINYIGFRDNFIGLMYYDNGAHSGSLATETGDINLVEQLQDRNTEISYQYMLADLMSRNHYYSQWNQPVDDYDLNVRVLTNIGYEEGPPGYCYPSTGMGNYPNTVMSVGTLVDNNGTTATTTSNTVAVMGFGSVPTMEINVQAYLQKCWMYANIAEYLPDKYKKAIQGTSETDPTTYSYMNSRLPNVNMADLFTHIGGRYSLDVMDNVNPFNHHRNRGLQYRSQILGNGRNVRFHIQVPQKFFAIKNLLLLPGTYSYEWWFRKDPNLVLQSTLGNDLRKDGASIQLAVISLYASFFPMDHATCSELILMLRNDQNDQTFMDYMGAKNNLYLVPANQTNVQIEIPSRAWTAFRGWSFNRIKTAETPAVWSTYDLNFKYSGSIPYLDGTFYLSHTFNSMSILFDSAITWPGNDRMLVPNFFEIKREIDTEGYTTSQSNMTKDWYLIQMSANYNQGYHGYSFPADKVYRQYDFMSNFDSMSVQVPRSGLAFLFNENYNLIVNNSGFLPSRTAPIAGVNEGHPYPANWPAPLIGNSPDSVVTVRKFLCDKYLWTIPFSSNFMNMGELTDLGQSLLYTESAHSLQITFNVDPMPEPTYIYLLYSVFDCVRVNQPNKNYLSAAYFRTPFATGTASV

SEQ ID NO: 57 - protein, 906 aa, Turkey adenovirus A
MDISNATPKLDIFHIAGPDASEYLSENLVNFISSTESYFPINKKFRETIVAPTKGVTTEQSQKLQVKIVPTLTQDLENSFTARFTIAVGDGRVLDMGSTYFDIRGNIDRGPSFKPYGGTAYNPLAPRSAQFNNIKTVGGKTYLTAQATKFFSTSGNGCAAANTEASSFTNLVPSPNTGSAESSFDPTTEGASCRAITLGSSVTDATCYGAYTPIQNANGSILPPSVTPDKKFADAGKSGSVTCTAAICCDNVTVQYPDTRIVAYDSTDKIATRMGNRINYIGFRDNFIGLMYYDNGAHSGSLATETGDINLVEQLQDRNTEISYQYMLADLMSRNHYYSQWNQAVDDYDLNVRVLTNIGYEEGPPGYCYPSTGMGNYPNTVMSVGTLVDNNGTTATTTSNTVAVMGFGSVPTMEINVQAYLQKCWMYANIAEYLPDKYKKAIQGTSETDPTTYSYMNSRLPNVNMADLFTHIGGRYSLDVMDNVNPFNHHRNRGLQYRSQILGNGRNVRFHIQVPQKFFAIKNLLLLPGTYSYEWWFRKDPNLVLQSTLGNDLRKDGASIQFSSISLYASFFPMDHATCSELILMLRNDQNDQTFMDYMGAKNNLYLVPANQTNVQIEIPSRAWTAFRGWSFNRIKTAETPAVWSTYDLNFKYSGSIPYLDGTFYLSHTFNSMSILFDSAITWPGNDRMLVPNFFEIKREIDTEGYTTSQSNMTKDWYLIQMSANYNQGYHGYSFPADKVYRQYDFMSNFDSMSVQVPRSGLAFLFNENYNLIVNNSGFLPSRTAPIAGVNEGHPYPANWPAPLIGNSPDSVVTVRKFLCDKYLWTIPFSSNFMNMGELTDLGQSLLYTESAHSLQITFNVDPMPEPTYIYLLYSVFDCVRVNQPNKNYLSAAYFRTPFATGTASV

SEQ ID NO: 58 - protein, 912 aa, Raptor adenovirus A
MDISNATPKLDIFHIAGQDASEYLSENLVDFITNTETYFPINKKFRETIVAPTKNVTTEQSQRLQVRIVPTLTQDLENSFTARFTIAVGDGRVLDMGSTYFDIRGRLDRGPSFKPYCGTAYNPLAPRSAQYNNIRKVGNTTVLTAQASNLYTIASSQNGAAAANTVANDFSNIVPSPNTGITESTVDNTTQGGSGRAVILPDEFPETTAYGAYASPTSVDGGQLPASKAIQKKYADAGKSGNVKVTSAFAGEELNVIYPDTRIVAYDNTAKLATRMGSRPNFIGFRDNFIGIMYYDNGAHSGSLATETGDINLVEQLQDRNTELSYQWLLNDLMSRQHYFTQWNQAVDDYDLNVRVLCNTGYEEGPPGQVYPITGMGNYPANVLKVGKMVTNTGSDANTVSNTLSIVGFGSVPAWEMNMQAQLQRSWLYSNIAEYLPDTLKYSAPLALDEDPTTYNYMNTRLPNVNVVDLFTNIGGRYSLDIMDNQNPFNHHKNRGLQYRSQILGNGRVCDFHIQVPQKFFAIKNLLLLPGTYTYEWWFRKDPNLVLQSTLGNDLRKDGAVIEYTNINLYASFFPMDHATCSELILMLRNDQNDQTFMDYLGAKNNLYVVPPDVSNLQIEIPSRSWTAFRGWSFNRMKASETPAVWSTYDVNFHYSGSIPYLDSTFYLSHTFNSLAITFDSAVPWPGNDRLLLPNFFEIKRNYDSEGYCTSQSNMTKDWWLIQMSANYNQGYHGYSYPADKTYRQYDFISNFDPMSIQVPANSINLISPSVQSSSKNAIWNNSGYVAPRDKTLATPNQGHPYPANWPAPLIGDYNVSMRTVRKFLCDKYLWTIPFSSNFMNMGELTDLGQSLLYTESAHSLQISFNLDPMPETTYVYMLYSVFDCVRVNQPNKNYVSAAYFRTPFATGTASA

SEQ ID NO: 59 - protein, 901 aa, Great tit adenovirus 1
MDISNGTPKLDIFHIAGQDASEYLSENLVDFITNTESYFPINKKFRETIVAPTKNVTTEQSQRLQVRIVPTLTQDLEHSYTARFTVAVGDGRVLDMGSPYFDIRGTIDRGPSFKPYQGTAFNPLAPRSAMFNNIRKIDNTTILTAQASHYYDVSSGNGCAEAQNEANRFSGIVPSPNVGLSESTMDHRSSGASGRVVLLADNKEATAYGAFAPAKQLNGSQLGVGTAIQPRFTNAGKEGNLTCTGAFAGEEIEVYYPDTRIVMWDDDTKIAVRMGKRPNYIGFRDNFIGLMYYDNGALSGSLATETGDINLVEQLQDRNTEISYQYMLADLMSRQHYYTQWNQAVDDYELGIRVLTNTGYEEGPPSFSFPSLGMGNYPYLGLDGGIMVENNGAAATDIANTAAGIGFGSVPSMELNLHAYIQRSWMYSNIAEYLPDNLKYDVPGLPPVPAANTYNYLNARLPHVNVVDLFTHLGGRYSLDVMDNQNPFNHHKNRGLQYRSQILGNARKVDFHIQVPQKFFAIKSLLLTPGTYTYEWWFRKDPNLVLQSTLGNDLRADGASVQFTSITLFASFFPMDHATASELILMLRNDTNDQTFMDYMGAKNNLYVVPPNTSNLQVEIPSRAWTGFRGWSFNRIKAQETPAIWSTYDVNFKYSGSIPFLDSTFYLGHTFNSVSITFDSAIPWPGNDRLLLPNYFQIQRRGPDAEGYCTCQSTMTKDWYLIQMLGNYNQGFHGYSFPVDKTFRQYDFIANFDPMCLQLPQNILDLSPIIVSNPDVVRNNSGYVAPRSSSIALRNEGHPYPANWPYPLIGEDVGGTSVGTRTVRKFLCDKYLWNIPFSSNFMNMGELTDLGQSLLYTESAHSLQLSFELEPMSDVTYVYLLFNVFDCVRVNQPNKNYVSAA

SEQ ID NO: 60 - protein, 920 aa, Frog adenovirus 1
MDIYNGTPKLDIFHIAGRDASEYLSENLIDFMSSTESYFSINKKFRETIVAPTKGVTSEQSQRLQVRIIPVQTQDAEQTYTARFTIAVGEGRVLDMGSTYFDIRGIVDRGPSFKPYSGTAYNSLAPKSAVFNNVKTVSIGGTNTSVLTAQAPHLYSINTGDNGCTAATTTAATFSGTVPNPGGGDIEQTFSSNEGGAGRVVNAQQDTGVYGAYAQPVNEAGNQNTAAVTSKFTNAGKGGNVTCTSAFAVETVGLTYPDTRVVAYDDDTGDVTRLGNRINYIGFRDNFVGLMYYDNGAHSGTLATETGDINIVEPLQDRNTEISYQYMLADLMSRHHYFAMWNQAVDDYELGVRVLSNHGYEEAMPALSFNTTGMGNYGGAALLSGQQVTINSNAATAVANSKALIGFGAVPSMEMNLGAQLARSWLFANVAEYMPDDLKVSVNVPQRYPQPGTNTSSYNYKNLRLPNVNLIDLFTQIGGRYSLSFMDNVNPFNHHKNRGLKYRSELLGNGRIAKFHIQVPQKFFAIKKLLLLPGTYTYEWWFRKDPNMVLQSSLGNDLRLDGATIQYTSINLFASFFPMDHATCNDLILMLRNETNDQSFMDYMGGKNNLYVVPPNTENLQIEIPSRTWEAFRGWSFNRLKTAETPSVWSTYDVNFKYSGSIPYLDGSFYLSHTFKNIAINFDSAVPWPGNDRMLVPNYFEIKRTGPDSEGYCVAQSNMTKDWFLVQMSGNYNQGYHGYSFPVDKTYRQYDFISNFDPMSIQMPDYTQQNIYDLLTAATSATGRDIIRNNTGFTANRLNPSVSDHTGHPYPCNWPYPLIGSQAVASVTHRKFLCDKYLWNIPFSSNFMNMGELTDLGQSLLYTNSSHSIQISIELEPMNETTYVYMIFGVFDAVRVNQPNKNSVSAAYFRTPFATGTASA

SEQ ID NO: 61 - protein, 944 aa, White sturgeon adenovirus
MDTLYKMTPVQTMHIMGPDASQYLSEGSKSLPPYGQKIFKLNNKFRDTVAAPLHVTTSESQRMAYMYSPQTIDNANQAYWSGRFQLPVPNNRILDMGGSFFDIEGTLDRGKSFKPYGGTAYNCLAPHSSTFNFIRGLVLNAQSGNAVAGLDAPLTASTDVQAAQTAMLTFSGSNPSPNVGLNYTPDPSGLLFGGRAVVLSEDATPTTPSYKDANAYGAYMTPLDIYGAVDDNVGKLYTCRAGVTDANNTARKITDLWACDNTQVSFPDTRVVSYNPDLMTTTRVGNRMNCVAFRDNFINMLYYDSTNTGVLESFANGNNVCLDSAQDRSTELGYQYWLAGVSSRYHNYDIFNQSIDSYDKRVRFFTNRGFDDGLPSYAYNTNARSGLTTGKMVDNTGAELVIQNNASIETQALVGNGKMTHYEINLKSQKFKNWIYTNISEYLPDKYKTPASVTGTNYPPFPTPGTDPTTYAYKNLMIPSQNIVDLFTNIGARYSIPQTDNVNPFNHHRNYGLNHRSMLLGNSRITNFAIQVPNKFFAIKNLALLPGNYNYEWKFRKDVNMVLQSTLGIDLRADEATIDYSRVKLYCPFFPFNHKDVAELDMLLRQQNNSQTFYDPLNSRSQFIEVPAGITNISVTVPAQSWSCFRGWKFNRLKASERCNKNAVYETGLKYSGTYPHIDGTYYLGHTFRALEIKWDTSVPWPGNDRLFSPNYFEMKRTLDNGFADNYCIAQCDMTKDWWLVQNSANYNQGYQGYQYPSSKTYFEYDFMRNFVPMSRQVPNMEPLKMDLQFGTATWALPYPGKSTFNNTIRNNSGFIAPRDAMPQTDARGAPYPANWPYPLISEKALPDGQIMTEKKFLCDKYLWNVPFSSNFFNMGELTDEGQSNMVVQSASNLQMNFNLDPMDEPTLIHILYGVFDCVQVSQPARNVISALYFRTPFNIGANA

SEQ ID NO: 62 - protein, 942 aa, Fowl adenovirus 1
MTALTPDLTTATPRLQYFHIAGPGTREYLSEDLQQFISATGSYFDLKNKFRQTVVAPTRNVTTEKAQRLQIRFYPIQTDDTPNSYRVRYSVNVGDSWVLDMGATYFDIKGVLDRGPSFKPYGGTAYNPLAPREAIFNTWVESTGPQTNVVGQMTNVYTNQTRNDKTATLQQVNSISGVVPNVNLGPGLSQLASRADVDNIGVVGRFAKVDSAGVKQAYGAYVKPVKDDGSQSLNQTAYWLMDNGGTNYLGALAVEDYTQTLSYPDTVLVTPPTAYQQVNSGTMRACRPNYIGFRDNFINLLYHDSGVCSGTLNSERSGMNVVVELQDRNTELSYQYMLADMMSRHHYFALWNQAVDQYDHDVRVFNNDGYEEGVPTYAFLPDGHGAGEDNGPDLSNVKIYTNGQQDKGNVVAGTVSTQLNFGTIPSYEIDIAAATRRNFIMSNIADYLPDKYKFSIRGFDPVTDNIDPTTYFYMNRRVPLTNVVDLFTNIGARWSVDQMDNVNPFNHHRNWGLKYRSQLLGNSRYCRFHIQVPQKYFAIKNLLLLPGTYTYEWVLRKDPNMILQSSLGNDLRADGAQIVYTEVNLMANFMPMDHNTSNQLELMLRNATNDQTFADYLGAKNALYNVPAGSTLLTINIPARTWEGMRGWSFTRLKASETPQLGAQYDVGFKYSGSIPYSDGTFYLSHTFRSMSVLFDTSINWPGNDRLLTPNLFEIKRPVATDSEGFTMSQCDMTKDWFLVQMATNYNYVYNGYRFWPDRHYFHYDFLRNFDPMSRQGPNFLDTTLYDLVSSTPVVNDTGSQPSQDNVRNNSGFIAPRSWPVWTAQQGEAWPANWPYPLIGNDAISSNQTVNYKKFLCDNYLWTVPFSSDFMYMGELTDLGQNPMYTNNSHSMVINFELDPMDENTYVYMLYGVFDTVRVNQPERNVLAMAYFRTPFATGNAV

SEQ ID NO: 63 - protein, 942 aa, Fowl adenovirus A; identical to SEQ ID NO: 62

SEQ ID NO: 64 - protein, 948 aa, Fowl adenovirus D
MAAFTPDLTTATPRLQYFHIAGPSTREYLSEDLQQFIAATGSYFELKNKFRQTVVAPTRNVTTEKAQRLQIRFYPTQTDDTPNSYRVRYSLNVGDSWVLDMGATYFDIKGVLDRGPSFKPYGGTAYNPLAPREAFFNNWLESEPNKTVITGLMTTPYRNDQGNKTNTADVVNSVSGVYPNPNLGPCISEMGALDDATADLVGFAGRFAKVTNENTRLAYGAYVKPLKNDGSQSLNPTPYWVMDKTDAKYLGVMAVEEFSTSLTYPDSLLIPPPSDYSTVNTGAMKANRPNYIGFRDNFINLLYHDTGVCSGTLNSERSGMNVVVELQDRNTELSYQYMLADMMSRHHYYALWNQAVDQYDHDVRVFNNDGYEEGVPTYAFSPEGTGYGANPNSNLSFADVKVHQNGAGDKGNEINTGGATYSTYLTVGSVPSYEIDLAASQRRNFIVSNIADYLPDKYKYNIDGFNPETGNVDPTTYEYMNRRVPLTNVVDLFTTIGARWSIDQMDNVNPFNHHRNWGLKYRSQLLGNSRYCRFHIQVPQKYFAIKNLLLLPGTYTYEWVLRKDPNMILQSSLGNDLRADGASIVYSEVNLMANFMPMDHNTSNQLELMMRNATNDQTFADYLGAKNALYQVPAGSTALTINIPARTWEGMRGWSFTRVKASETPQIGAQYDINFKYSGSIPYSDGTFYLTHTFRNMSVLFDTSINWPGNDRLLAPNLFEIKRNVSINAEGFTMSQCNITKDWYLIQMATNYNYVFNGYRFWPDRQYFHYDFLRNFDPMTCQGPNFQDQTLFDLMSYDPVQTPGAVQTNQDAIRNNSGYTAPRSWPVYGAQQGESWPANWPYPLIGDSSLNPTQIVNYKKFLCDNYLWTVPFSSDFMYMGELTDLGQNPMYTNNSHSMVINFELDPMDENTYVYMLYGVFDMVRVNQPERNVLAMAYFRTPFATGNAV

SEQ ID NO: 65 - protein, 935 aa, Northern Aplomado falcon adenovirus
MAAFTPDLTTATPRLQYFHIAGPGTREYLSEDLQQFISATSSYFDLKNKFRQTVVAPTRNVTTEKSQRLQIRYYPTQTDDTTHGYRVRYSLTVGDSWVLDMGSTYFDIKGFIDRGPSFKPYSGTAYNPLAPRESLFNFWQEKSGNKYVSGQLSNVYTNDNSTTNASTWESAKDFSQTSPNPNVGPFVSDPNLLGTLEKIGVSGRIAKVGSNTVPLTYGAYVKPTSVTGSQTADFTRYYIMDSAGTKYQGAVAVEDVSHTLSYPDTLRIAPAIETSGVDSGISKSLRPNYIAFRDNFINLLYHDTGACSGTLSSERSGMNVVVELQDRNTELSYQYMLADMMSRHHYFALWNQAVDSYDHDVRVFNNDGYEEGVPTYAFQPNGVGNYEAGPDLSESKLFTISSTNHDKETDQNATMNIAWGPVVANEICMSAAMKRNFIMTNIAEYLPDKYKFNIPGFSADNADRRSYEYMNHRVPLVNVVDLFTNLGARWSVDQMDNVNPFNHHRNWGLKYRSQLLGNSRYCQFHIQVPQKYFAIKSLLLLPGTYTYEWVLRKDPNMVLQSTLGNDLRLDGARIVYQEVNLMASFMPMDHNTSNQLELMMRNAVNDQTFADYLGAKSALYSVPAQSTVLTINVPARTWEGMRGWSFTRLKAEETPQQGAQYDINFRYSGSIPYQDGTFYLNHTFRNMSILFDTSINWPGNDRMLTPNMFEIKRSPAADAEGYGMSQSTITKDWFLVQMATNYNYVYNGYRFWPDRHYFHYDFLRNFDPMSMQGPDFNNTDTFDLVTYTHQSPTRHTKTKQNKKRNNSGMVADRAGAPFNKRQGQLWPSNWPYPLIGKESLPVEKILNYRKFLCDNYLWTIPFSSDFMYMGELTDLGQNPMYTNNSHSMVINLEMDPMDENTLVYMLYGVFDTVRVNQPERNVLAMAYFRTPFATG

SEQ ID NO: 66 - protein, 963 aa, Feline adenovirus
ATPSMMPQWSYMHISGQDASEYLSPGLVQFARATETYFSLNNKFRNPTVAPTHDVTTDRSQRLTLRFIPVDREDTAYSYKARFTLAVGDNRVLDMASTYFDIRGVLDRGPTFKPYSGTAYNALAPKGAPNSCEWEQEEPTQEMAEELEDEEEAEEEEAEEEAEAPQADQKVKKTHVYAQAPLAGEKITANGLQIVSDTQTEGNPVFADPTYQPEPQVGESQWNEAEATASGGRVLKKTTPMKPCYGSYARPTNKNGGQGILVANNQGALESKVEMQFFAPSGTAMNERNAVQPSIVLYSEDVNMETPDTHISYKPSKTDENSKAMLGQQAMPNRPNYIAFRDNFIGLMYYNSTGNMGVLAGQASQLNAVVDLQDRNTELSYQLLLDSIGDRTRYFSMWNQAVDSYDPDVRIIENHGTEDELPNYCFPLGGIGVTDTYQGIKSNGNGNPQNWTKNDDFAARNEIGVGNNFALEINLNANLWRNFLYSNIALYLPDKLKYTPTNVEISPNPNSYDYMNKRVVAPGLVDCYINLGARWSLDYMDNVNPFNHHRNAGLRYRSMLLGNGRYVPFHIQVPQKFFAIKNLLLLPGSYTYEWNFRKDVNMVLQSSLGNDLRVDGASIKFDSICLYATFFPMAHNTASTLEAMLRNDTNDQSFNDYLSAANMLYPIPANATNVPISIPSRNWAAFRGWAFTRLKTKETPSLGSGYDPYYTYSGSIPYLDGTFYLNHTFKKVAITFDSSVSWPGNDRLLTPNEFEIKRSVDGEGYNVAQCNMTKDWFLVQMLANYNIGYQGFYIPESYKDRMYSFFRNFQPMSRQVVDDTKYKDYQQVGILHQHNNSGFVGYLAPTMREGQAYPANFPYPLIGKTAVDSITQKKFLCDRTLWRIPFSSNFMSMGALTDLGQNLLYANSAHALDMTFEVDPMDEPTLLYVLFEVFDVVRVHQPHRGVIETVYLRTPFSAGNATT

SEQ ID NO: 67 - protein, 931 aa, Simian adenovirus 1
MATPSMMPQWSYMHIAGQDASEYLSPGLVQFARATDTYFSLGNKFRNPTVAPTHDVTTDRSQRLTLRFVPVDREDTAYSYKVRYTLAVGDNRVLDMASTYFDIRGVLDRGPSFKPYSGTAYNSLAPKGAPNPAEWTNSDSKVKVRAQAPFVSSYGATAITKEGIQVGVTLTDSGSTPQYADKTYQPEPQIGELQWNSDVGTDDKIAGRVLKKTTPMFPCYGSYARPTNEKGGQATPSASQDVQNPELQFFASTNVANTPKAVLYAEDVSIEAPDTHLVFKPTVTEGITSSEALLTQQAAPNRPNYIAFRDNFIGLMYYNSTGNMGVLAGQASQLNAVVDLQDRNTELSYQLMLDALGDRSRYFSMWNQAVDSYDPDVRIIENHGVEDELPNYCFPLGGMAVTDTYSPIKVNGGGNGWEANNGVFTERGVEIGSGNMFAMEINLQANLWRSFLYSNIGLYLPDSLKITPDNITLPENKNTYQYMNGRVTPPGLVDTYVNVGARWSPDVMDSINPFNHHRNAGLRYRSMLLGNGRYVPFHIQVPQKFFAIKNLLLLPGSYTYEWNFRKDVNMILQSSLGNDLRVDGASIRFDSINLYANFFPMAHNTASTLEAMLRNDTNDQSFNDYLCAANMLYPIPANATSVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQSNMTKDWFLIQMLSHYNIGYQGFYVPENYKDRMYSFFRNFQPMSRQIVDSTAYTNYQDVKLPYQHNNSGFVGYMGPTMREGQAYPANYPYPLIGATAVPSLTQKKFLCDRVMWRIPFSSNFMSMGSLTDLGQNMLYANSAHALDMTFEVDPMDEPTLLYVLFEVFDVVRIHQPHRGVIEAVYLRTPFSAGNATT

SEQ ID NO: 68 - protein, 921 aa, Simian adenovirus 7
MATPSMMPQWSYMHIAGQDASEYLSPGLVQFARATDTYFSLGNKFRNPTVAPTHDVTTDRSQRLTLRFVPVDREDTAYSYKVRYTLAVGDNRVLDMASTYFDIRGVLDRGPSFKPYSGTAYNSLAPKGAPNPSEWTDTSDNKLKAYAQAPYQSQGLTKDGIQVGLVVTESGQTPQYANKVYQPEPQIGENQWNLEQEDKAAGRVLKKDTPMFPCYGSYARPTNEQGGQAKNQEVDLQFFATPGDTQNTAKVVLYAENVNLETPDTHLVFKPDDDSTSSKLLLGQQAAPNRPNYIGFRDNFIGLMYYNSTGNMGVLAGQASQLNAVVDLQDRNTELSYQLMLDALGDRSRYFSMWNQAVDSYDPDVRIIENHGVEDELPNYCFPLGGMVVTDNYNSVTPQNGGSGNTWQADNTTFSQRGAQIGSGNMFALEINLQANLWRGFLYSNIGLYLPDSLKITPDNITLPENKNTYQYMNGRVTPPGLIDTYVNVGARWSPDVMDSINPFNHHRNAGLRYRSMLLGNGRYVPFHIQVPQKFFAIKNLLLLPGSYTYEWNFRKDVNMILQSSLGNDLRVDGASIRFDSINLYANFFPMAHNTASTLEAMLRNDTNDQSFNDYLCAANMLYPIPANATSVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQSNMTKDWFLIQMLSHYNIGYQGFYVPENYKDRMYSFFRNFQPMSRQVVDTVTYTDYKDVKLPYQHNNSGFVGYMGPTMREGQAYPANYPYPLIGETAVPSLTQKKFLCDRVMWRIPFSSNFMSMGSLTDLGQNMLYANSAHALDMTFEVDPMDEPTLLYVLFEVFDVVRIHQPHRGVIEAVYLRTPFSAGNATT

SEQ ID NO: 69 - protein, 956 aa, Simian adenovirus 21
MATPSMLPQWAYMHIAGQDASEYLSPGLVQFARATDTYFNLGNKFRNPTVAPTHDVTTDRSQRLMLRFVPVDREDNTYSYKVRYTLAVGDNRVLDMASTFFDIRGVLDRGPSFKPYSGSAYNSLAPKGAPNTSQWLDKGVTTTDNNTENGDEEDEVAEEGEEEKQATYTFGNAPVKAEAEITKEGLPIGLEVPSEGDPKPIYADKLYQPEPQVGEESWTDTDGTDEKYGGRALKPETKMKPCYGSFAKPTNVKGGQAKVKKVEEGKVEYDIDMNFFDLRSQKTGLKPKIVMYAENVDLETPDTHVVYKPGASDASSHANLGQQSMPNRPNYIGFRDNFIGLMYYNSTGNMGVLAGQASQLNAVVDLQDRNTELSYQLLLDSLGDRTRYFSMWNQAVDSYDPDVRVIENHGVEDELPNYCFPLDGVGPRTDSYKGIETNGDENTTWKDLDPNGISELAKGNPFAMEINIQANLWRSFLYSNVALYLPDSYKYTPTNVTLPENKNTYDYMNGRVVPPSLVDTYVNIGARWSLDAMDNVNPFNHHRNAGLRYRSMLLGNGRYVPFHIQVPQKFFAVKNLLLLPGSYTYEWNFRKDVNMVLQSSLGNDLRVDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSIMFDSSVSWPGNDRLLTPNEFEIKRTVDGEGYNVAQCNMTKDWFLVQMLANYNIGYQGFYVPEGYKDRMYSFFRNFQPMSRQVVDEINYKDYKAVAVPYQHNNSGFVGYMAPTMRQGQAYPANYPYPLIGTTAVTSVTQKKFLCDRTMWRIPFSSNFMSMGALTDLGQNLLYANSAHALDMTFEVDPMDEPTLLYLLFEVFDVVRVHQPHRGVIEAVYLRTPFSAGNATT

SEQ ID NO: 70 - protein, 949 aa, Unknown
  Unidentified adenovirus
MATPSMLPQWAYMHIAGQDASEYLSPGLVQFARATDTYFNLGNKFRNPTVAPTHDVTTDRSQRLMLRFVPVDREDNTYAYKVRYTLAVGDNRVLDMASTFFDIRGVLDRGPSFKPYSGTAYNSLAPKGAPNTSQWIAEGVKKENGESDEEEEKNLTTYTFGNAPVKAEGGDITKDKGLPIGSEITDGEAKPIYADKLYQPEPQVGDETWTDTDGTAEKYGGRALKPETKMKPCYGSFAKPTNVKGGQAKQKTTEQLQNQQVEYDIDMNFFDQASQKANFSPKIVMYAENVDLETPDTHVVYKPGTSEESSHANLGQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGVGVPTTSYKIIEPNGEGADWKEPDINGTSEIGQGNLSAMEINLQANLWRSFLYSNVALYLPDSYKYTPANVTLPTNTNTYDYMNGRVVPPSLVDTYVNIGARWSLDAMDNVNPFNHHRNAGLRYRSMLLGNGRYVPFHIQVPQKFFAVKNLLLLPGSYTYEWNFRKDVNMVLQSSLGNDLRVDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSIMFDSSVSWPGNDRLLTPNEFEIKRTVDGEGYNVAQCNMTKDWFLVQMLANYNIGYQGFYVPEGYKDRMYSFFRNFQPMSRQVVDEINYKDYKAVAVPYQHNNSGFVGYMAPTMRQGQAYPANYPYPLIGTTAVTSVTQKKFLCDRTMWRIPFSSNFMSMGALTDLGQNLLYANSAHALDMTFEVDPMDEPTLLYLLFEVFDVVRVHQPHRGVIEAVYLRTPFSAGNATT

SEQ ID NO: 71 - protein, 932 aa, Simian adenovirus 3
MATPSMMPQWSYMHIAGQDASEYLSPGLVQFARATETYFSLGNKFRNPTVAPTHDVTTDRSQRLTIRFVPVDKEDTAYSYKTRFTLAVGDNRVLDMASTYFDIRGVIDRGPSFKPYSGTAYNSLAPKGAPNNCQWQSGVQPKVNTYGQAAFINDFVDNNNGHTGIKVGDNAEGQPIVADPTFQPEPQTGGLDTQWNTVPNTNNLKLEAAGRALKYTTPMKPCYGSYARPTNENGGQGTLGNNGKTTPAELQFFDLASKNNDYSPAVTMYTEDVYLETPDTHIIYNPETVNGNTNTQLLLGQQAAPNRPNYIGFRDNFIGFMYYNSTGNMGVLAGQASQLNAVVDLQDRNTELSYQLMLDALGDRTRYFSMWNQAVDSYDPDVRIIENHGVEDELPNYCFPLSAVGIVNDYKGITKNGGNWQVDQTDSDRNEIATGNIFAMEINLQANLWRSFLYSNVALYLPDSYKYTPANVTLPENKNTYGYINGRITAPGLIDTYVNIGARWSPDPMDNVNPFNHHRNAGLRYRSMLLGNGRVVPFHIQVPQKFFAIKNLLLLPGSYTYEWSFRKDVNMILQSTLGNDLRVDGASVRIDSVNLYANFFPMAHNTASTLEAMLRNDTNDQSFNDYLSAANMLYPIPANATNVPISIPSRNWAAFRGWSFTRLKAKETPSLGSGFDPYFVYSGTIPYLDGSFYLNHTFKRLSIMFDSSVSWPGNDRLLTPNEFEIKRVVDGEGYNVAQSNMTKDWFLIQMLSHYNIGYQGFYVPEGYKDRMYSFFRNFQPMSRQIVDPTSYTAYQAVALPHQHNNSGFVGYMGPTIREGQPYPANYPYPLIGATAVPAITQKKFLCDRVLWRIPFSSNFMSMGALTDLGQNMLYANSAHALDMTFEVDPMDEPTLLYMLFEVFDVVRVHQPHRGIIEAVYLRTPFSAGNATT

SEQ ID NO: 72 - protein, 903 aa, Equine adenovirus 2
MATPSMMPQWSYMHIAGQDASEYLSPGIVQFAQARKPYFHLGNKFRNPTVAPTHERTTERFAEACSCAFVPVDKEDTVYTYKTRFQLAVGNNRVLDMGRTYFYIRGTLDRGPSFKPYSGTQYNQLAPKGAPNPCQYQKNNTTVTFGQAAFEGVEITASGLRIAVDKYCDPTYQPEPQIGIDSWEPGTTLSDDIAAVGGRVLNNQQNPTPCYGSYAPPTNVDGGQGDGNPTLKFFKTGTQAARPDIVLYSENVNLMMPDSHIVYKVGTDEEQSRAALAQQAAPNRPNYVAFRDNFIGLLYYNSNGNLGVLAGQASQLNAVVDLQNRNTELSYQLLLDSLVDRNRYFAMWNQAVDSYDPDVRIVENVGVEDEMPNYAYPLSGMNPTAANRNSWRSRVPNEEGWVSKGNLDALELNIPANLWRGFLYSNVAMYLPDKYKFTPPNTTLPENENTYDYMNGKLPAAGLIDSYVNVGSRWSLDVMDNINPFNHHRNAGLRYRSQILGNGRYCKFHIQVPQKFFAIRNLLLLPGTYTYEWSFRKDVNMILQSTLGNGLRVDGASITYENITLYASFFPMAHNTASTLEAMLRNDTNDQSFIDYLSAANMLYTIPAGATQVPISIPSRNWAAFRGWSFTRIKAKETPALGSPFEPYFNYSGTIPYLDGTFYLSHTFRRVSVQFDSSALGPETTVFFTPNEFEIKRLIDGEGYNVSQSNMTKDWFLVQMLAHYNIGYQGYHLPESYKDRWYGPLRNFQPLCRQVPDPLRFTDYKAVSVLNQHNNSGFTGYNSAGLMREGQPYPANWPYPLIGKNAVASVTERKFLCDKTLWRIPFSSNFMSMGTLTDLGQNLLYANAAHALDMTFEVDPMEEPTLLYLLFQVFEVARVHQPHRGVIEVVYLRTPFSAGNATT

SEQ ID NO: 73 - protein, 952 aa, Human adenovirus 5
MATPSMMPQWSYMHISGQDASEYLSPGLVQFARATETYFSLNNKFRNPTVAPTHDVTTDRSQRLTLRFIPVDREDTAYSYKARFTLAVGDNRVLDMASTYFDIRGVLDRGPTFKPYSGTAYNALAPKGAPNPCEWDEAATALEINLEEEDDDNEDEVDEQAEQQKTHVFGQAPYSGINITKEGIQIGVEGQTPKYADKTFQPEPQIGESQWYETEINHAAGRVLKKTTPMKPCYGSYAKPTNENGGQGILVKQQNGKLESQVEMQFFSTTEATAGNGDNLTPKVVLYSEDVDIETPDTHISYMPTIKEGNSRELMGQQSMPNRPNYIAFRDNFIGLMYYNSTGNMGVLAGQASQLNAVVDLQDRNTELSYQLLLDSIGDRTRYFSMWNQAVDSYDPDVRIIENHGTEDELPNYCFPLGGVINTETLTKVKPKTGQENGWEKDATEFSDKNEIRVGNNFAMEINLNANLWRNFLYSNIALYLPDKLKYSPSNVKISDNPNTYDYMNKRVVAPGLVDCYINLGARWSLDYMDNVNPFNHHRNAGLRYRSMLLGNGRYVPFHIQVPQKFFAIKNLLLLPGSYTYEWNFRKDVNMVLQSSLGNDLRVDGASIKFDSICLYATFFPMAHNTASTLEAMLRNDTNDQSFNDYLSAANMLYPIPANATNVPISIPSRNWAAFRGWAFTRLKTKETPSLGSGYDPYYTYSGSIPYLDGTFYLNHTFKKVAITFDSSVSWPGNDRLLTPNEFEIKRSVDGEGYNVAQCNMTKDWFLVQMLANYNIGYQGFYIPESYKDRMYSFFRNFQPMSRQVVDDTKYKDYQQVGILHQHNNSGFVGYLAPTMREGQAYPANFPYPLIGKTAVDSITQKKFLCDRTLWRIPFSSNFMSMGALTDLGQNLLYANSAHALDMTFEVDPMDEPTLLYVLFEVFDVVRVHRPHRGVIETVYLRTPFSAGNATT

SEQ ID NO: 74 - protein, 382 aa, Ovine adenovirus 7
MSSKKVTKSIKKRKSTTEEFQNKVQAALEILAKFGECVKVDTSQMKFHPEEGDCEKLFAQYMKKMKIINLTYSSSKSMATVGGRMLYSAICKQIDLIPNFNASGCYLWYHDWEEDRPRCFHGDFMFKRVNEIEMPPTSEAGVQALKEGRGVLSNGRMNKQVVKIVQEHYVLCAEDAHQRFGQCSPRSCGLNFSDEKKALLAMQNAIETTKAVFPKAKVGNMLFILGQCECNYGGKQTIGKQLPKITPFSISGVEGIDVQDVNRVQAAAVTFPAVFVFQCCNYQYNLRRNNGKFCEMKISLPDMLQCLTLVRKFWNECMGNNIPIQFSQFKWNQSFQVKNTMLPNIEEDSDMNPFGTIEEPTPSKKKKTILESSSEEEDEDED

SEQ ID NO: 75 - protein, 380 aa, Bovine adenovirus 4
MSTKKGSKLARKGRSENEETQQKIQAALEIVSKFGEYVKVETSQMKFHPEEGDCEKLFSQYLKKHKSINLTYSNFKSMAIVGGRMLYSAICKQIGLVPNFNVTGCYLWYHDWDERPRCFHGDFMLKKVNEIEMSPTSEMGIQALKEGRGILCNGKMNKQVVKVVQENFMLCSEDAQQRFGQCSPRSCGLNFSDEKKALIAMQNAFQTTKAVFPNAKIGNMLFILGQCECNYGGKLVIGKQLPKITAYTITGVEGIDAQDVSKVQAAAVMYPAVFVFQCCNFQFTSKRNTTKFCEMKISVPDMLQCLTLVRKFWFECMGTPLPINFPQFKWNQCFQVKNTVLPSIEEDVEANPFGEVEEAPPKKKKRTVLESSSEEDDEDD

SEQ ID NO: 76 - protein, 380 aa, Bovine adenovirus D; identical to SEQ ID NO: 75

SEQ ID NO: 77 - protein, 387 aa, Duck adenovirus A
MSSKKSTATSSKKAKRSAGLTDTELERQQNESLFQAALEVVYKLGEHLKVETKDVTFHPFDTGLEKLFAQTLKKAKYTPIYSAAKSMNVVGGRLLYGAICNYVGLAPNFNPTGCSLWEHGWEEGVRCYHSEKMILKENIIEMTPTSEAAISALKEGRGLLSSNKYGKQVVRIVQENSMICPEDLRQTRFGTFSNSSCGLNFTDGEKAKLAYKNATAYIQAVFPKTAMQHLLFIVTACECNYGGQLILGKQIPKMTPYTVSGVENISVKDLDPVKAVGVKYPAVFVFQCCNFQGQKRAGNAKSCEFKISLPDLIHCLITARNLWFEVMGEPMPVQFPLFKWSPALQVKNTLLPSCDVCTEDNPFGEIPTKRKRVVEIESDEDEEEDED

SEQ ID NO: 78 - protein, 397 aa, Snake adenovirus
MSLSKTKNPALLAGPGDEAKEKVQAALELLHKFGSAFKVDTAGFSFHPESPECDKIFGAYLKNVKHVPTYSSAKTLTSVGGRILYAATCQYVKLTPVTNLTGCTLWEHGWGQNLKCYHGEGMCRKKNEIEMAATSESGVAALKEGRGAVEINRWGRQVVKITQENYVICMEDLQSRFNQPSANSCGLSFSDSDKARSAMENATELTRSIFSQAKMDHLLFMPICCYCNYGGKMILGRQLCKLTPFSISGTEGLREEDVSPVQAVSVRHPAVFVFQCCNATGGSKGKTSCDFKISHADLLQVLNLVRKMWLEVMGYPMPIHFPRFKWSPSLRVKNALLPEGSVNEDENPFGLDNSEDEEEVVPPSPPSPARKRTRTTVAEVHHKKKKKIVLESSEEDE

SEQ ID NO: 79 - protein, 441 aa, Fowl adenovirus 1
MERTPKRAHGFRSTKPVKRTAEVMMEEEEEEVEVVAPGRGATRKKVSRREESPSPVRRVTRRRETVVDDEENASDEESPEAPLSDPVVYGAQRAMATVASICEALDLQWQGASVRPDDSIWTKMGGTYVRKKHPEFRLTFSSYDSFNAQVGRFLAAVIYSRAGLEPKFVPGGAHVWRHGWFPALQEPFPKCMHGVDMVTKPRTVELNPSSEAGKRALAEQNGVIEKNRFGRQVVVLRFDANAVCYKDQEHSGFPHPHAHGSCAMVFSDAAKAVSAMRHDIDWTKALYPNADKRRAEECVLISTNCNCNYASDRAISGRQFCKMTPYKLNGTDDITRDMVESRPDMKAHKKNPHTMVFTCCNPQAASGGAGRGLKKTEKTCAWRLSAMDLRYAYVFATELFTAVMGSSEPTHVPEFRWNESYAFKTEVLAPVSPIASDDPFA

SEQ ID NO: 80 - protein, 549 aa, Fowl adenovirus A
MAETLHPETISSDEDVADFVDLEEPGPSTVIKSNRGRSRPLPPQRPTGPKDPENPLEKQKSEDLPRSHPGPRKLQKTLPPSPAVVPDSEEEGEQELFETRDPVTEAEVMERTPKRAHGFRSTKPVKRTAEVMMEEEEEEVEVVAPGRGATRKKVSRREESPSPVRRVTRRRETVVDDEENASDEESPEAPLSDPVVYGAQRAMATVASICEALDLQWQGASVRPDDSIWTKMGGTYVRKKHPEFRLTFSSYDSFNAQVGRFLAAVIYSRAGLEPKFVPGGAHVWRHGWFPALQEPFPKCMHGVDMVTKPRTVELNPSSEAGKRALAEQNGVIEKNRFGRQVVVLRFDANAVCYKDQEHSGFPHPHAHGSCAMVFSDAAKAVSAMRHDIDWTKALYPNADKRRAEECVLISTNCNCNYASDRAISGRQFCKMTPYKLNGTDDITRDMVESRPDMKAHKKNPHTMVFTCCNPQAASGGAGRGLKKTEKTCAWRLSAMDLRYAYVFATELFTAVMGSSEPTHVPEFRWNESYAFKTEVLAPVSPIASDDPFA

SEQ ID NO: 81 - protein, 437 aa, Fowl adenovirus 9
MVKDSAPKTTSKKMASSDDHENAEPAMVDSKKKRSAKSRGAAPSKKARKETQEREEVDEKKSELDVESDEELERPLSDPVEYGAQKAMKILTTICDRLDVRWQGSTIRPDDAIWTRIGGTFVRKRHPEFRLTFSSFDSFHNQVGRFLAAMVYGMAELEPKFVPEGAHVWRHGWEATTNTTPKCLHGNAMFLKPRTVELNPTSEAGKRAIAEQNGQIEKNRFGKQVVVLRFDRNAVCSRDADHSGFPYPHVIGSCGMAFSDAAKAVSAMRHDLEWTKALYPNAEKRRAEEHILISTNCNCNYAVQGPISGRQVCRMIPYKLSGTDDIASDTARSRPDMKAHKKYPHTMVYTCCNPQSPSGTDGPTSRSGRKTSDKTCAWRLSAMDLRHAYVFATELVLNAMGVQAPTHVPEFRWHERFGFKTEVIAPVKPVETGDPFA

SEQ ID NO: 82 - protein, 556 aa, Fowl adenovirus D
MAEAADRDLWVVSSDEDDEEIRQVFGAREKTPMPNSDDSESDWSQPKTRPLQEAPLPKETLPPSDRRGTGSCSLPRWHKSHPVKVQKRRLEVEEVFSSSEESSPGEDEEEEEGETDRSGMVKDSAPKTTSKKMASSDDHENAEPAMVDSKKKRSAKSRGAAPSKKARKETQEREEVDEKKSELDVESDEELERPLSDPVEYGAQKAMKILTTICDRLDVRWQGSTIRPDDAIWTRIGGTFVRKRHPEFRLTFSSFDSFHNQVGRFLAAMVYGMAELEPKFVPEGAHVWRHGWEATTNTTPKCLHGNAMFLKPRTVELNPTSEAGKRAIAEQNGQIEKNRFGKQVVVLRFDRNAVCSRDADHSGFPYPHVIGSCGMAFSDAAKAVSAMRHDLEWTKALYPNAEKRRAEEHILISTNCNCNYAVQGPISGRQVCRMIPYKLSGTDDIASDTARSRPDMKAHKKYPHTMVYTCCNPQSPSGTDGPTSRSGRKTSDKTCAWRLSAMDLRHAYVFATELVLNAMGVQAPTHVPEFRWHERFGFKTEVIAPVKPVETGDPFA

SEQ ID NO: 83 - protein, 346 aa, Turkey adenovirus 3
MQYATGLQALFACQAEANILPTSDYWAKLVETYVKKNKPDLNLTISSAKSFYHFAGRIVSSFVYNDSGLICNYNCLGANIWVHNWDEDNIRCFHGTVMLSKPITYSLSPQSEEGMRALTAGEGRLEKEKNQKDVIKLTNYSNIVCPLDSNVQWPTIHSPDSCGMNFGNKEKAKAAFLHNIDWTSAMFPKAKKCEISEKMIIVTKCFCNYGHENIQLGRQICKMTAFEIPGANDIDPESCHDDMLLATAKYKHTFVFQCCNPIRLKRNAKDKDNQTHKHCDFKLSMIDVRQAMKISKDIYTKLKETIDDGSPTKIMLPAFVFNPKKHSFKQAIVAQHEVESDDDAFC

SEQ ID NO: 84 - protein, 380 aa, Turkey adenovirus A
MSSDQRSLVDSEEEPCLKRQRVENDEFENCHQKAMQYATGLQALFACQAEANILPTSDYWAKLVETYVKKNKPDLNLTISSAKSFYHFAGRIVSSFVYNDSGLICNYNCLGANIWVHNWDEDNIRCFHGTVMLSKPITYSLSPQSEEGMRALTAGEGRLEKEKNQKDVIKLTNYSNIVCPLDSNVQWPTIHSPDSCGMNFGNKEKAKAAFLHNIDWTSAMFPKAKKCEISEKMIIVTKCFCNYGHENIQLGRQICKMTAFEIPGANDIDPESCHDDMLLATAKYKHTFVFQCCNPIRLKRNAKDKDNQTHKHCDFKLSMIDVRQAMKISKDIYTKLKETIDDGSPTKIMLPAFVFNPKKHSFKQAIVAQHEVESDDDAFC

SEQ ID NO: 85 - protein, 378 aa, Frog adenovirus 1
MSEKRPAVDHEEEPQAKKQLEDNFILCEEAAKNYASALAGMIGCPTDVNLLPTSEFWARISENYIKKFRTDFFLTNSTLKSFTHYLGRLLASYVHATAGFEPKFNILGSEIWVHNWEEGENLELRCFHGEKMMKKTISYELVPTTVEAVKALASGEGKLEKGKGNKDVVKIVNNKNYVCPKDIDYNGFPAIHASTSCGLNFANGEKAKSAFLHYADWTQAMYPKANRASIREKMIIVTRCLCNFGHDNVQVGRQISKLTPFEIPGSNDLTQDQMDECGMMKATGQHQATIVFLCCNPVNFRAKVTIAKNCDFKLSMIDLRLAIKMSKEIWAKLNDQLEGKLAPAKLAFPVFKFDPKRHCYKSAVVCAQEVEEDEDVFC

SEQ ID NO: 86 - protein, 461 aa, Murine adenovirus 3
MSCSRPLPPHRVGQQQVFGSRKGGMKRLPPTEAGESSKRSRTVAEAVTSTGGSGSTGGIGDRPLGAVCDSPTNPEPQEEVLPRRRFESSDEEEDVFDDGTVTEEEACWQTAREFLHKMCLPLKVDGKQCTFLPNAQTAELFRKLCHSWLLQQKMVPSLTFTTLRSFTMQMGRFVLALLLQASGLSPTEAAAHSIANVSGVAAWKHASDVTLHCLHGAVMIAKDHHVDLDVSSEGGQRALKEQGPNAVVTTNRWGRSVVRVKYDAFVCPMDAGVPFNQPSNKSCGFCFTDGKKALKGFKQIVAFQAALYPQAAGGGEWMLLCLRCECNFGVAQPILGRQTCRLTPYQLSLAEGLDGGNMDAVAKASVENPVVLVAQCCNVTFSKAGKAGGAAAGKTCEWKISSVDLVTAAQLAKKMIHKMLDLPPSLFVPEFKWDPVFSFRSTVLPQGVGDSDLQLFTTGGM

SEQ ID NO: 87 - protein, 461 aa, Murine adenovirus A
MSCSRPVPPQRTPQQQVYETKRGGVKRSAVGEASTAHCGKKSRAALGPRSSPLAPAVSGKFANVSGGDRGSEDVNMEPEPQTEVPPRFESSDEDDVVFTEAGVAEEEEACWQTARELLHKMCLVLKVDGKQCTFLPNAQTAELFRKLSHSWLLQQKLVPSLTFSTLRSFTMQMGRFVFAMLLQAAGISPVDFAAHTLGNVTGVAAWKHNCSTTLHCLHGTAMSPKDHQVELDVTTEGGQRALKEQGSAACVQTNRWGRSVVRVTYDAVVCAMDASVAFNQPTNKSCGFCFTDAKKALKGFKQAIAFQQALYPQAPGVGERMLLCLRCECNFGLAQPILGRQTCRVTPYALSLAEGLDATALDPVARASVENPVVLVYQCCNVTFGKAGKGTVGKSCEWKISSVDVVTAAQLAKKMIQKLLDQPPSLFVPEFKWDPTLCFHSTVLPQGAGDGDVQLFVTAKV

SEQ ID NO: 88 - protein, 513 aa, Simian adenovirus 22
MAGRGGSQSEQRRQERTPERGRGSASRPPNRESPSPPPLPQKRHAYRRVVSDDGQEEEIVVVSENSRSPSTSPPPPLPPKKKPRKTKHVPLQDISQDSEDERQAEEELAAVGFSFPPVRITEKDGKRVFETLDENDPLTSAAATKMTTAVKNPLSLPIVSAWEKGMEVMTLLMDRYRVESDLKSAFQLMPEQGEVYRRICHLYVNEEHRGIPLTFTSNKTLTTMMGRFLQGFVHSHSQIAHKNWECTGCALWLHGCTEAEGKLRCLHGTVMIQKEHTIEMDVASENGQRALKENPDRAKITQNRWGRSVVQLANNDARCCVHDAGCATNQFSSKSCGVFFTEGGKAQQAFRQLEAFMKAMYPGMSSEQAQMMLIPLHCDCNHKPGCVPSMGRQTCKMTPFGMANAEDLDVEGITDATVLASVKHPALMVFQCCNPVYRNSRAQNAGPNCDFKISAPDLLGALQLTRKLWSDSFPDLPVPKLLIPEFKWLPKYQFRNVSLPAGHAESRQNPFDF

SEQ ID NO: 89 - protein, 512 aa, Simian adenovirus 24
MAGRGGSQSEQRRQERTPERGRGSASRPPNRESPSPPPLPQKRHAYRRVVSDDGQGEEIVVVSENSRSPSTSPPPPLPPKKKPRKTKHVPLQDISQDSEDERQAEEELAAVGFSFPPVRITEKDGKRVFETLDENDPLTSAAATKMTTVKNPLSLPIVSAWEKGMEVMTLLMDRYRVESDLKSAFQLMPEQGEVYRRICHLYVNEEHRGIPLTFTSNKTLTTMMGRFLQGFVHSHSQIAHKNWESTGCALWLHGCTEAEGKLRCLHGTVMIQKEHTIEMDVASENGQRALKENPDRAKITQNRWGRSVVQLANNDARCCVHDAGCATNQFSSKSCGVFFTEGGKAQQAFRQLEAFMKAMYPGMSSEQAQMMLIPLHCDCNHKPGCVPSMGRQTCKMTPFGMANAEDLDVEGITDATVLASVKHPALMVFQCCNPVYRNSRAQNAGPNCDFKISAPDLLGALQLTRKLWSDSFPDLPVPKLLIPEFKWLPKYQFRNVSLPAGHAESRQNPFDF

SEQ ID NO: 90 - protein, 512 aa, Simian adenovirus 23
MAGRGGSQSEQRRQERTPERGRGSASRPPNRESPSPPPLPQKRHAYRRVVSDDGQEEEIVVVNENSRSPSTSPPPLPPKKKPRKTKHVPLQDISQDSEDERQAEEELAAVGFSFPPVRIIEKDGKRVFETLDENDPLTSAAATKMTMAVKNPLSLPIVSAWEKGMEVMTLLMDRYRVESDLKSAFQLMPEQGEVYRRICHLYVNEEHRGIPLTFTSNKTLTAMMGRFLQGFVHSHSQIAHKNWECTGCALWLHGCTEAEGKLRCLHGTVMIQKEHTIEMDVASENGQRALKENPNRAKITQNRWGRSVVQLANNDARCCVHDAGCATNQFSSKSCGVFFTEGGKAQQAFRQLEAFMKAMYPGMSSEQAQMMLIPLHCDCNHKPGCVPSMGRQTCKMTPFGMANAEDLDVEGITDATVLASVKHPALMVFQCCNPVYRNSRAQNAGPNCDFKISAPDLLGALQLTRKLWSDSFPDLPVPKLLIPEFKWLPKYQFRNVSLPAGHAESRQNPFDF

SEQ ID NO: 91 - protein, 462 aa, Simian adenovirus 1
MANRQNQAGSSITPYLREMSPEREQEAPQLPPKKKARKATPAPPPSPEIVSDSEGEGTVVEVGFSYPPVRRVRRADGSVEFQRMTMKDVGAGEGPSTAVLVKNPDSKPLVTAWEKGMETMMMLMEKFHVDNDSRAAFKFLPDQGAVYRKICQTWLNEEHRGLPLTFTNQKTFTELMGRFLMAYMEAYAGVKHKSWEPTGCAVWEHRSTQQEGVLFCFHGVEMVCKEHVLEMDVTSENGQRALKEHPTRAKVVQNRWGRNVVQLKNEDARCCAEDVNCGHNVFSSKSCGLFYTEGGKAQMAFRQMEEFLAASYPIMQRGQRRILIPLRCDCLNKRDLVPQIGRQMCKLTPFALSNAEDLDASEVTDPTALASIHNPGVLVFQCANPVFRNSRGSSGPNCDFKISAPDVMGALQLVRQFWKQNLEDVPLPRLVIPEFRWSARFQYRNVSLPSGHEDPSLEPFDF

SEQ ID NO: 92 - protein, 462 aa, Simian adenovirus 7
MANRQNQPGSSITPYLREMSPEREQEVPPLPPKKKARKSAPVPPPSPEIVSDSEGESTVMEVGFSYPPMRRVRRADGTVEFQKMSMKDVGAGEGPSTAVLVKNPESAPLVTAWEKGMEVMTMLMEKFHVDNESRTTFKFLPDQGAVYRKICQTWLNEEHRGLPLTFTNQKTFTELMGRFLMAYMEAYAGVKHKSWESTGCAVWEHRNTQQEGILFCFHGVEMVCKEHVVEMDVTSENGQRALKEHPTKAKVVQNRWGRNVVQLKNEDARCCAEDINCGNNVFSSKSCGLFFTEGVKAQMAFRQIEEFLAASYPIMQRGQRRILIPLRCDCLNKRDLVPQIGRQMCKLTPFALSNAEDLDASEVTDPTALASIHNPSVLVFQCANPVFRNSRGGSGPNCDFKISAPDVMGALQLVRQFWKQNMEDVALPRLVIPEFRWSARFQYRNVSLPSGHEDPSLEPFDF

SEQ ID NO: 93 - protein, 493 aa, Cynomolgus adenovirus 1
MADRQDQRERTPERPRPATPSIRRYLQASPERAPTPAPPQKKARKSLLAPLAEMPPSPEIVLDSDDEENLAIAEESQAGVVTMVGFSYPPVQITRNPDGSRAFKKLPPPPLPADAEKDEEQPSTSRAAVVVRNPLSKPVVSAWEKGMAVMHVLMDKYKIEDRAAFHFMPQSFEVYRKICHTWLQEDLKYCPLTFSTQKTFSAMMGRFLNKYVLLHAGIENPLYKSWEPTGCVVWEHRCTEQEGQLMCLHGLPMIAKDHVVEMDVSSEAGQRALKETPQLAKVVQNRWGRNVVQLRHDNARCCMFDAQCGTNVFSGKSCGMFYSEGGKAQQAFRQIEAYMQAAYPHMQRGQKHLLMPLRCDCNYLGDAVPRAGRQVCKITPFALPGAEDMKHDEVTDPVALASLNHPSLLVFQCANPAYRNTRATNQVNCDFKISATDVLLALQLVRNLWHDHFVEAGLPKMVLPEFKWQPRYQYKNLTLPTAHLDYQLNPFEF

SEQ ID NO: 94 - protein, 472 aa, Bat adenovirus TJM
MSHVISSSSDEDIPVPVRKRQRKSKEDAKARAKESPRPEKEDSSLVGHGYALEMTRRANAILEAQGKPGGFYIQTFCGQRVEKDANGEIQFIKQDPPSAPPLPMDPALKAQLMEPLIQAAVDMRPTKANEHQWQLGMEMALKILTAYQVDHKELTLLPDSGTLECFKKAAQAYLVNTKTVVTYNFTTQKSFQHMVGRILLDFVIKAAGVAPGLNPSGCVVWQHGCQRQLHCLHGSPMIQKEQLIEMDVNSENAQRVLKENPEKTKIVTNRWGRNVVQMKNEDAYCCFMDVNISGGNFSSSSCGMSYTDGPKALMAFQQIMAFQRACYPQMSTAESHLLMPLKCECNWNNSLPMLGRQTCKMTPYALSSTADIDRSLVQDAKMLATLDHPAMLVFQCCNPVYRNSKAAPQKNCDFKISTVDMVACVQIAKKIWSTCIGTPPPLKFPEFKWSQEYKYQTTILPQGQEDNDVSLF

SEQ ID NO: 95 - protein, 454 aa, Canine adenovirus 1
MSHKKVVAISESSSDEEVPVAPPTAPPKKRQRKAVEEPRGHQAMVEIARQATAALKARGDPGSIIVQTFCDQTVDVDKEGNVIFTPAKQKSICNKSGSPLASVASKIFKASEHKWQSAMEFALKVLNAYQVDHSKLTLLPDEGTLECFKKAVQAYITTSKMHVTYTFTNQKTFLHVAGRLLLDFVIKAAELAPGVNPSGCVVWQHGCQSSLMCLHGSPMIQKEQLVEMDVNSENAQRALKENPEKTKIVSNRWGRNVVQFKNEDAFCCSMDVNMSGGNFSGASCGMFYTDGPKAIMAFQQIMAFLKACYPSMPNAESHLLMPLKCECNWNSSLPLLGRQTCKITPFSLASANHIDKSEVDDQKMLATLNNPAMLVFQCCNPVYRNSKAAPQKNCDFKISSVDLVSCLQIAKQIWLSTVGEKPPVKFPEFHWSDEHRYQTTILPQGQHDDDLVLF

SEQ ID NO: 96 - protein, 454 aa, Canine adenovirus 2
MSHKKVVAISESSSDEEVPVAPPTAPPKKRQRKAVEEPRGHQAMVEIARQATATLKARGDPGSIVVQTFCGQTVDTDKEGNVVFIPPKQKSVWSKPNAPSGLVASKFFKASEHKWQSAMELALKVLTAYQVDHSKLTLLPDEGTLECFKKAVQAYITTSKTHVTYTFTNQKTFLHVAGRLLLDFVIKAAELAPGVNPSGCVVWQHGCQSSLMCLHGSPMIQKEQLVEMDVNSENAQRALKENPEKTKIVSNRWGRNVVQFKNEDAFCCSMDVNMSGGNFSGASCGMFYTDGPKAIMAFQQIMAFLKACYPSMPNAESHLLMPLKCECNWNSNLPLLGRQTCKITPFSLASASHIDKSEVDDQKMLATLNNPAMLVFQCCNPVYRNSKAAPQKNCDFKISSVDLVSCVQIAKQIWTSTVGERPPIKFPEFHWSDEHRYQNTILPQGQHDDDLVLF

SEQ ID NO: 97 - protein, 435 aa, Bovine adenovirus 10
MSQESQNDFLTNESVFMDENVAKKARKRPLSVINTEAVEDIEEIEEMFSVGFSNPPCKLGPKQIVKKKAGFLTGGQLSCKKSKTVEEVDWQKAMDLAVQILQPLKVDIKELTLVPDAYKFRNFRKAMPKLGCNDKKIHLNLTFSTQKTVTTLMGRFIFSFVLRAGGMAPSNWNPTGCVIWNHKCLDNLKCFHGLTMVSKDQLVEMDVTSENAQRALKETPQKAKITTNRWGRSIVQLKNEDAACCFHDASCNAGTFSNKSCGLFYTEGQKALQAFKQIMEFQKACYPKMANAMSHLLLPIKCDCNWGTGYMPLLGRQMCKVTPFSMSGGRLIVEKHLIDRIPKLLAYLCNNPSILVFQCCNPVYRHSKANPQKNCDFKISAPDVILALQLAKQMWSSLINCPVPLVLEEFKWQTQYQYQNTILPVAYVDTDESLF

SEQ ID NO: 98 - protein, 441 aa, Porcine adenovirus 5
MRFVTFFSILHLEKMSRNHYEDVSDSSADDEPRLVIDDQPKPKKIARRRKADGDKLDGAAKSHDESNKKRARVLSDTDEETPSTSVKSSKLLLDRNEVKWQKAMDVAMSLMVPLKVDTKDLTLLPDHATMECFKKAAQAWMSDRKKFIQLTFSTQKSLLTVMARFLFDFVIREAELNTPDWNPTGCVVWNHKCGDRLHCLHGMAMINKEQLVEMDINSENGQRALKETPEKAKIVTNRWGRSVVQIRNSDAMCCVNDAKSPINTFSPQSCGYFYSDGPKAVTAFRQIAAFVKAIYPNMATAESHLLMPLVCECNYGANHLPLLGKQTCKVTPFAMSTAGNIDRNLIDDPKVLATLDHPAVLVFQCCNPVFRNTKANPQKNCDFKISSTDVVSALQLAKQMWQNIIGTKVNLSVPEFRWHPQYQVQNTILPTGQHDDDDCLF

SEQ ID NO: 99 - protein, 442 aa, Ovine adenovirus A
MSQNHYEDIFDSDEEGKLVIDETPRVKKVTKRKKATEDITPPTTPDIVEPASSKKVRVIESDDEAPSTSKGKKRSVVSKPNVSPAAKISRKLLDQNEMKWQKAMDVAVSFLVPLKVDIKDLTLLPDAGTMECFRKGVQSWLNEQKRFVPLTFSTQKSLQTAVARFVFDFVLRAAEICPADWNPNGCVVWEHKTNEEKLYCLHGLPMINKEQIVEMDINSENGQRALKESPERAKIVTNKWGRSVVQMKNADAMCCFYDLKSSLNSFSSESCGYFYSDGNKARQGFYQIRDFVKAMYPQMPKAGEMLLMPLVCECNYGHHVIPLLGKQTCKVTPFALNAVSNIDRSLVEDAKVLATLNNPVVLVFQCCNPVFRNTKANPQKNCDFKISSTDVVMALQLAKQMWSSLTGTKASIVVQEFKWQPQYRVQNTLLPTGQDDADECLF

SEQ ID NO: 100 - protein, 457 aa, Porcine adenovirus 3
MSRRYSDVSDYDSGEEGVLIVDDAPVATPSRRGGGRKRAASPPVQERRKRARAKPLVSEEEEDEAEETAAATARPARRKGEDGEEEEGARPPRPVTPSPAVARPLLQLDAQEQKWQRAMDLAVQMLVPLKVDVKGLTLLPDGSTLECFRRGAQAWLNERKISCQLTFSTQKSLLTVMARFLLDFVVKAAGLKTPEWNPCGCVIWQHRSGSEGLHCLHGLPMINKEQLVEMDLNSENGQRALRETPERAKITTNRWGRNVVQLRNDGAMCCSHDVGSAPNTFSARSCGLFYSEGSKAQQAFEQLKAFQKACYPRMGNAETHLLMPLVCDCGWGCRQVPLLGRQTCKITPFALSGSAALNPQLVEDPKILASVTHPAVLVFQCYNPVYRGSRGNPQKNCDFKISAPDVMLALQLTKQMWAALMQTRPPLTVPEFKWGPQFQVQNTIFPVGTEDDDESLF

SEQ ID NO: 101 - protein, 432 aa, Bovine adenovirus B
MNRSGDLTRATSSADSSGDENPLVIDETPRKKVSRKRRAPIAEPPAEDVTAVKRAKIFKPSAPAAEAAAPALPAASRALLEADEVAWQRAMELAVGLCVPLKVDIKNLTLLPDTGTLECFRKVAQAWLNESKVYLPLTFSTQKTVLTIMGRFLYDFVLKVAGLGTTSWSPTGCVVWRHQCTEGGDGALHCLHGLPMLTKDQVIEMDVNSENGQRALKETPHKTKITTNRWNMNVVQLKNEDAACCHFDAALPAGSFTSKSCGMFFSEGPKALQAFWQIMTFQKACYPRMQSAGTHLLMPLKCDCNWGHSQLPLLGRQVCKITPFNINAGSAVDKSLVEDPKLLASVEHPSVLVFQCCNPVYRQTRANAQRNCDFKISAPDMISALQLVKQMWSALVKQSPPITIPEFRWDPQYQHQNVILPIDQYDADDSLF

SEQ ID NO: 102 - protein, 467 aa, Tree shrew adenovirus
MSDRHDYSSDSSSDMIICENEPAPKETQGPSVMRVGFSNPPVEIIRSGGGKTTHKSLGPNWRRKLPSLDQLMKGEPADESSQDSTKSSPEKRPSTSGEPAAIKKRRKAVVPNKLVSSDETKWQMVMDMAVNMLTPLKVDLKDLTMLADQGTLECFQKAAQAWMTERKIYTPLTYSTQKTLLSLMGRFLFHFIMTKVGESDHGGKAWPKNTNVSGAVVWKHQSGATLSCLHGLTMLNKEQIVEMDVSSENGQRALKETPEKTKITTNRWGRNVVQVRNEDAMCCQFDAPLPANNFSTKSCGMFYSEGEKAKTAFKQIMALQRACYPKMDGEQIVIPIKCDCNWASTTPLLGRQVCKVTPFTISATESIDRELVQDPKILATVHNPAVLVFQCCNPVYRNSRANPQKNCDWKISAPDVMTALQLAKQMWQHVFKEPPVVRIPEFKWSAAYQYQNTILPTGVDDTDDSLF

SEQ ID NO: 103 - protein, 529 aa, Human adenovirus 5
MASREEEQRETTPERGRGAARRPPTMEDVSSPSPSPPPPRAPPKKRMRRRIESEDEEDSSQDALVPRTPSPRPSTSAADLAIAPKKKKKRPSPKPERPPSPEVIVDSEEEREDVALQMVGFSNPPVLIKHGKGGKRTVRRLNEDDPVARGMRTQEEEEEPSEAESEITVMNPLSVPIVSAWEKGMEAARALMDKYHVDNDLKANFKLLPDQVEALAAVCKTWLNEEHRGLQLTFTSNKTFVTMMGRFLQAYLQSFAEVTYKHHEPTGCALWLHRCAEIEGELKCLHGSIMINKEHVIEMDVTSENGQRALKEQSSKAKIVKNRWGRNVVQISNTDARCCVHDAACPANQFSGKSCGMFFSEGAKAQVAFKQIKAFMQALYPNAQTGHGHLLMPLRCECNSKPGHAPFLGRQLPKLTPFALSNAEDLDADLISDKSVLASVHHPALIVFQCCNPVYRNSRAQGGGPNCDFKISAPDLLNALVMVRSLWSENFTELPRMVVPEFKWSTKHQYRNVSLPVAHSDARQNPFDF

SEQ ID NO: 104 - protein, 215 aa, Murine adenovirus 1
MSAPSPYVWTFQPQRGTAAGASQDYSTRINWLSAGPELRGKVVQLNEARNAILMKEQESVPTPRAEANPSFWPAALIFQPRPQAIPVHPAHPDTFDAALTSNGAQLAGGAWINYKNGSVRYEAPLQLAEEQVGGPLNAFAIKHQLQLAGGALSASMSEMSGAPRIPRSGGIGSWQFSREFPPTVYLNPFSGSPDTFPHQFLSNYDSFSHTVDGYD

SEQ ID NO: 105 - protein, 218 aa, Murine adenovirus 3
MSAPSPYMWTFQPQRGTAAGASQDYSTRLNWLSAGPSLRGKVIEVNQARNSILLNQQEAVPTPRRDINPPSWPASLIFHPRPKPIAVLPAHPDSFDPNVTLEGAQLAGGAWVRYKSGNEVRYTAPIQLAEEPTSRTPTAYALAQELQLAGGATATPPLMGELAGAPRVPRSGGIGSWQFTQEFPPTVYLNPYSGAPDTFPHQFLSNYDSVSQSVNGYD

SEQ ID NO: 106 - protein, 217 aa, Ovine adenovirus 7
MAQPVTPYVWKYQPETGYTAGAHQNYNTVINWLHANPQMFARIQHINTARNVMDKFRSDLTRDDIAVNINNWPAEDLMQPPNFPYIPATSKSASTINDWLATTQGIQLSGTSELNGWGSNRLTSYPDIPPILKYERPGQQLQGQGLFKQENIHLFYESPRLPRSGGLTPQQFVKEFPPVVYNNPFSESMSVFPKEFSPLFNPSESLKKTSSQTLQYK

SEQ ID NO: 107 - protein, 217 aa, Ovine adenovirus D; identical to SEQ ID NO: 106

SEQ ID NO: 108 - protein, 222 aa, Bovine adenovirus 4
MQPVTPYIWKYQPETGHTAGAHQDYGSVINWLQSNPQMFNRIRDINLQRNNIDQTQGLMTRDDLHSNINNWPASQVLQRQGFPYVPAKMNLEASKQDFIDSARGIQLSGPNPVFTGTGSNNLTSYPMLTENIPPLMLYHRPGQQLQGMGTISKENFHLLEEVSRVPRSGGLTPTEFLTQFPPIVYRHPFSSSLIYFPKEFDPLFSPHNDPRLTSSKTLQYVP

SEQ ID NO: 109 - protein, 250 aa, Duck adenovirus 1
MQPVTPYLWRYQPETGTAAGARQDYGAVINWFNSGPDLYRRIRDVNITRNNVEQTRALARTPLSGNFNRWTAAQLTHPPGTRYKPYFPVDSIKGARDRVATQQGQILAGAGYDLHDGRQYRKITRDALPFPHNWQVKDGSRWVNLGGKGANSLTTYPVIADIPPIMRYGRPGQQLQGSGFHRPSPALLTEEARVPRSHGMTVRQFVHEFPPVVFNHPFSEDITYFPKEFNPLFNPSEDYRVSSDRTLQYV

SEQ ID NO: 110 - protein, 278 aa, Snake adenovirus
MEAPVTPYIWQYQPETGTAAGARQNYGAVINWLSSDNNMYHRVQEVNRQRNKIDDFREQTVRADMAHSFNDWKPQQLSQPASTAYLPAPNPIAGPRTIPDVIFTAEGEQLAGASPSLLSGGASLPPSSYRLGDGREYRKFTRDAMPFPHNWLVKENGVWVPVEERDPLLSEEGRNALSSYPTLTYAQPPILRYRRLGQQLQGGGVVAPSSRVVSLLTEQPRMPRTEGMTPYQFSAEFPPVVYDHPFSRNLTLFPKEFSPLFDPKDQVLATSLATLQYR

SEQ ID NO: 111 - protein, 246 aa, Fowl adenovirus 10
MNLLNAAPTPYVWKYNPVTGKCAGANRTTAHYRLVLPGGNSFAYAADEIRRRFPEPAVTRAITARFEAESDQQPYAGPHETNIITADVVRSGPPPSAVYPFDPSGVQRVQLSGGMMGGRTEGRVQLSGGLTEGRMQLAGGAAGKLPTRARPTLRPPRWCGTTLTGNGLPADYPEMTPDAFKYYLRVQGPSQEVDEPGVMSQRQFMTTFLPAMVPHPFDSESPDAFPAYFSSVYKGTNGFEPVFWQG

SEQ ID NO: 112 - protein, 244 aa, Fowl adenovirus 8
MNLLEATPTEYVWKYNPLSGIPAGAQQNYGATINWVVPGGNSFAYAADEIRRHTLSPAATRAITERFEAESDQQPFANARETAYITANVLDSGFPKSAVYPVDPSGVQRVQLSGGAEGRMQLAGGLTEGRVQLSGGVLGHVVPPGGRRRAGGRPPRWCGTALAGNGLPEDAEVVSDTYKYFLRTQGPSQVVQEPGVYSRRQFMTTFLPAVVPRPFSSPNPRDFPAQYSAIYKGTNAYEDVFWDW

SEQ ID NO: 113 - protein, 241 aa, Fowl adenovirus 9
MNLLDATPTEYVWKYNPLSGIPAGAQQNYGATINWVVPGGNSFAYAADEIRRNTLSPAVTRAITARFEAESDQQPFANPRETAYITANVLDSGFPKSAVYPVDPSGVQKVQLAGGAEGRMQLSGGLTEGRVQLSGGVLGHVPRRSRRGARPPRWCGTALAGNGLPEDAEMVSDTYKYFLRTQGPSQVVSEPGVYSQRQFMTTFLPAVVPHPFDSPNPNDFPAQYSAIYKGTNAYEDVFWDW

SEQ ID NO: 114 - protein, 245 aa, Fowl adenovirus 1
MNLMNATPTEYVWKYNPVSGIPAGAQQNYGATIDWVLPGGTGFAIATNDIRRQTLNPAVTRAITARFEAESDQQPYASPHETNVIAANVLDSGYPKSGLYPLELSGNQRVQLAGGLMVGRTEGRMQLAGGLTEGRVQLSGGFHGRPLVRGRSRRPPRWCGAELTGNGLPEQAEVTSDTYKYFLRTQGPSQVVEEPGVFSQRQFMTTFLPSVVPHPFDSTNPGDFPAQYSAIYKGRTAFEDTFWDW

SEQ ID NO: 115 - protein, 200 aa, Turkey adenovirus 3
MDPVPLEYIWQYNPVTGRVGGANQNYGQRINVLHTNRYLYNRMQNVQKKSNERATERGLLSLKGGSTLPTIAEDEPAQLNSAIVRMAGLNDLNTVQAPDSSNLQNLANIALEAAEHNKATSSLLTTKKFVEEFPPVVYENPFSGSNFAYEFNPLYSPSGNEFSNPPFKFTGGAISLTGQHPVLSGGAVILSGQNPVLDKA

SEQ ID NO: 116 - protein, 200 aa, Avirulent turkey hemorrhagic enteritis virus; identical to SEQ ID NO: 115

SEQ ID NO: 117 - protein, 200 aa, Turkey adenovirus A; identical to SEQ ID NO: 115

SEQ ID NO: 118 - protein, 193 aa, Frog adenovirus 1
MEAEPSEYIWQYNPVTGRVVGASQNFGARINTLHASPQLWARMQQVQRRRNETVTLSALQGSGLVPATPSAFQTTDSSNCFLGGSDNWKELLEPVPESEENPNQALQDLLLAAESEKDQRNRNLTQSQFVSDFPPVVYERPFTGSDFPLEFSPLYSPDGNQFTNTGWISQSFPPNQSFPEIINHPTQHSSTTI

SEQ ID NO: 119 - protein, 221 aa, Porcine adenovirus 4
MPLAKEIPTPYVWSYQPQMGVPAGASQDYSTKINCLSAGPRMAQTVFALRDQRNRVLTAEAHGQTPRPVVNPASWPAAALSHEPPPPTLLTLPRNEPTEHAMTDAGYQIAGGAAPWSGVKTGSFCGRGLQLAEPPTTAIYPSGLFHLGRGQRLVLDHQPARTLLLESAPSVPRYGGIGARQFLKEFTPAVYPQPYSGPPNTFPDYFCFNYDSVSNSVDGYS

SEQ ID NO: 120 - protein, 198 aa, Bovine adenovirus 10
MSKEIPTPYVWNYQPQAGTAAGASQDYSTRLHWLSAGKSMISKVNTICENRNSILLSKGMQQLARLNANPPFTNRSQSVTALKLPRYEILEQRMSNSGMQLAGGSLSLAEPLCKQPLAPDGSFQLGGGAKVFSRGATNYAIRKTILLLEYSGGMGEKQFVKEFVPAVYFNPYSGLPASYPDQFISNYDAVTDSVDGYA

SEQ ID NO: 121 - protein, 216 aa, Bovine adenovirus 3
MSKEIPTPYVWTFQPQMGAAAGASQDYSTRMNWFSAGPDMIHDVNNIRDAQNRILMTQSAITATPRNLIDPRQWAAHLIKQPVVGTTHVEMPRNEVLEQHLTSHGAQIAGGGAAGDYFKSPTSARTLIPLTASCLRPDGVFQLGGGSRSSFNPLQTDFAFHALPSRPRHGGIGSRQFVEEFVPAVYLNPYSGPPDSYPDQFIRHYNVYSNSVSGYS

SEQ ID NO: 122 - protein, 227 aa, Tree shrew adenovirus
MSKDIPTPYVWTFQPQMGVAAGASQDYGTKMNWLSAGPSMIHRVNNIREARNRILLRQAALTETPRAVMNPPNWPSTLLYHDVAPPTSVPLPRNERLEIAMTNHGAQLAGGGHTSLPEGLKRELLFGSGIQLNEQLPVRPYGAAVRADGTFQLAGGSRSSFNPREELFLKLQSAPSQPRSGGIGSWQFVEEFVPAVYYNPFSGPPGTYPDQFISNYDVVSDSVDGYD

SEQ ID NO: 123 - protein, 221 aa, Bovine adenovirus 1
MSKDIPTPYVWTFQPQLGGCGASQDYSTRMNWLSAGPSMINQVNSVRADRNRILLRQAAVSETPRLVRNPPTWPAQYLFQPIGAPQTFELPRNESLEVAMSNSGMQLAGGGRRTKDIKPEDIVGRGLELNSDIPSASFLRPDGVFQLAGGSRSSFNPGLSTLLTVQPASSLPRSGGIGEVQFVHEFVPSVYFQPFSGPPGTYPDEFIYNYDIVSDSVDGYD

SEQ ID NO: 124 - protein, 223 aa, Ovine adenovirus A
MSKEIPTPHMWTFQPQLGQAAGASQDYSTRMNWLSAGPSMISQVDSIRAERNRILLHQAAVSATPRAIMNPPAWPASRLFQPVDTVQTLELPRNELLETAMTNSGMQLAGGGVHRTKDIKPEDLVGRGIQLNSYQPPTTRLKPERVFQLAGGSRSSFNPSINTLLTLQPAASVPRSGGIGEVQFVHEFVPSVYFQPFSGPPGSYPDEFIYNFDVATDSIDGYA

SEQ ID NO: 125 - protein, 224 aa, Canine adenovirus 2
MSKEIPTPYMWSYQPQTGHAAGASQDYSTQMNWFSAGPSMISQVYGIRDLRNKVLITQAEITKTPRTIMDPPIWPAAMLVQEAAPPKTVTLPRNHTLEQAMTNSGAQLAGGRQLCPSQIGIKSPVLAGTGIQLSEDIPSASWIRPDGIFQLGGGSRSSFSPTQAFLTLQQASSTPRAGGVGTYQFVREFVPEVYLNPFSGPPDTFPDQFIPNYDIVTNSVDGYD

SEQ ID NO: 126 - protein, 224 aa, Canine adenovirus 1
MSKEIPTPYIWSYQPQTGHAAGASQDYSTQMNWFSAGPSMISHVYGIRDLRNKVLMTQAQITKTPRTIMDPPIWPASMLVQKHATPKTIALPRNHTLEQAMVNCGAQLAGGRQPSPSHIDIKDTMLAGTGIQLGEDIPSVSWIRPDGIFQLGGGSRSSFSPTQAFLTLQQASSTPRTGGVGSYQFVREFVPEVYLNPFSGPPDTFPDQFIPNYDIVTNSVDGYD

SEQ ID NO: 127 - protein, 222 aa, Bat adenovirus TJM
MSKEIPTPYMWSFQPQSGHAAGAAQDYSTQMNWFSAGPSMINQVYQIRDLRNRILTTQAQITETPREVMNPPVWPAATIVQEAPPPTTVALPRNHALETAMTNSGIQLAGGRCLLPAARAACPIKGRGLQLSEDIPSASWIRPDGIFQLGGGSRSSFNPTQAFLTLQQASSQPRAGGIGTVQFVREFVPEVYLNPFSGPPDTFPDQFIPNYDIVTNSVDGYD

SEQ ID NO: 128 - protein, 223 aa, Porcine adenovirus 1
MSKQIPTPYMWSYQPQSGRAAGASVDYSTRMNWLSAGPSMIGQVNDIRHTRNQILIRQALITETPRPVQNPPSWPARLLPQMTQPPTHLHLPRNEILEGRLTDAGMQLAGGGALAPRDLYALTLRGRGIQLNEDLPFSASTLRPDGIFQLGGGGRSSFNPTDAYLTLQNSSSLPRSGGIGSDQFVREFVPTVYINPFSGPPGTYPDQFIANYNILTDSVAGYD

SEQ ID NO: 129 - protein, 223 aa, Porcine adenovirus 3
MSKQIPTPYMWSYQPQSGRAAGASVDYSTRMNWLSAGPSMIGQVNDIRHTRNQILIRQALITETPRPVQNPPSWPASLLPQMTQPPTHLHLPRNEILEGRLTDAGMQLAGGGALAPRDLYALTLRGRGIQLNEDLPLSASTLRPDGIFQLGGGGRSSFNPTDAYLTLQNSSSLPRSGGIGSEQFVREFVPTVYINPFSGPPGTYPDQFIANYNILTDSVAGYD

SEQ ID NO: 130 - protein, 227 aa, Simian adenovirus 22
MSKEIPTPYMWSYQPQMGLAAGAAQDYSTRMNWLSAGPAMISRVNDIRARRNQILLEQSAITATPRHHLNPRNWPAALVYQEIPQPTTVLLPRDAQAEVQLTNSGVQLAGGAALCRHRPAQGIKRLVIRGRGTQLNDEVVSSSLGLRPDGVFQLAGSGRSSFTPRQAVLTLESSSSQPRSGGIGTLQFVEEFTPSVYFNPFSGSPGHYPDEFIPNFDAISESVDGYD

SEQ ID NO: 131 - protein, 227 aa, Simian adenovirus 23
MSKEIPTPYMWSYQPQMGLAAGAAQDYSTRMNWLSAGPAMISRVNDIRAHRNQILLEQSAITATPRHHLNPRNWPAALVYQEIPQPTTVLLPRDAQAEVQLTNSGVQLAGGAALCRHRPAQGIKRLVIRGRGTQLNDEVVSSSLGLRPDGVFQLAGSGRSSFTPRQAVLTLESSSSQPRSGGIGTLQFVEEFTPSVYFNPFSGSPGHYPDEFIPNFDAISESVDGYD

SEQ ID NO: 132 - protein, 227 aa, Simian adenovirus 24; identical to SEQ ID NO: 131

SEQ ID NO: 133 - protein, 233 aa, Simian adenovirus 1
MSKEIPTPYMWSYQPQMGLAAGAAQDYSSKMNWLSAGPHMISRVNGIRAHRNQILLEQAAITATPRRQLNPPSWPAAQVYQENPRPTTVLLPRDAEAEVLMTNSGVQLAGGSRYARYRGRAAPYSPGSIKRVIIRGRGIQLNDETVSSSTGLRPDGVFQLGGAGRSSFTTRQAYLTLQSSSSQPRSGGIGTLQFVEEFVPSVYFNPFSGSPGRYPDAFIPNFDAVSESVDGYD

SEQ ID NO: 134 - protein, 233 aa, Simian adenovirus 7
MSKEIPTPYMWSYQPQMGLAAGAAQDYSSKMNWLSAGPHMISRVNGIRAHRNQILLEQAAITATPRRQLNPPSWPAAQVYQETPRPTTVLLPRDAEAEVLMTNSGVQLAGGSRYARYRGRAAPYSPGSIKRVIIRGRGIQLNDEAVSSSTGLRPDGVFQLGGAGRSSFTTRQAYLTLQSSSSQPRSGGIGTLQFVEEFVPSVYFNPFSGSPGRYPDAFIPNFDAVSESVDGYD

SEQ ID NO: 135 - protein, 227 aa, Human adenovirus 5
MSKEIPTPYMWSYQPQMGLAAGAAQDYSTRINYMSAGPHMISRVNGIRAHRNRILLEQAAITTTPRNNLNPRSWPAALVYQESPAPTTVVLPRDAQAEVQMTNSGAQLAGGFRHRVRSPGQGITHLTIRGRGIQLNDESVSSSLGLRPDGTFQIGGAGRPSFTPRQAILTLQTSSSEPRSGGIGTLQFIEEFVPSVYFNPFSGPPGHYPDQFIPNFDAVKDSADGYD

SEQ ID NO: 136 - protein, 951 aa, Human adenovirus 5
MATPSMMPQWSYMHISGQDASEYLSPGLVQFARATETYFSLNNKFRNPTVAPTHDVTTDRSQRLTLRFIPVDREDTAYSYKARFTLAVGDNRVLDMASTYFDIRGVLDRGPTFKPYSGTAYNALAPKGAPNPCEWDEAATALEINLEEEDDDNEDEVDEQAEQQKTHVFGQAPYSGINITKEGIQIGVEGQTPKYADKTFQPEPQIGESQWYETEINHAAGRVLKKTTPMKPCYGSYAKPTNENGGQGILVKQQNGKLESQVEMQFFSTTEAAAGNGDNLTPKVVLYSEDVDIETPDTHISYMPTIKEGNSRELMGQQSMPNRPNYIAFRDNFIGLMYYNSTGNMGVLAGQASQLNAVVDLQDRNTELSYQLLLDSIGDRTRYFSMWNQAVDSYDPDVRIIENHGTEDELPNYCFPLGGVINTETLTKVKPKTGQENGWEKDATEFSDKNEIRVGNNFAMEINLNANLWRNFLYSNIALYPDKLKYSPSNVKISDNPNTYDYMNKRVVAPGLVDCYINLGARWSLDYMDNVNPFNHHRNAGLRYRSMLLGNGRYVPFHIQVPQKFFAIKNLLLLPGSYTYEWNFRKDVNMVLQSSLGNDLRVDGASIKFDSICLYATFFPMAHNTASTLEAMLRNDTNDQSFNDYLSAANMLYPIPANATNVPISIPSRNWAAFRGWAFTRLKTKETPSLGSGYDPYYTYSGSIPYLDGTFYLNHTFKKVAITFDSSVSWPGNDRLLTPNEFEIKRSVDGEGYNVAQCNMTKDWFLVQMLANYNIGYQGFYIPESYKDRMYSFFRNFQPMSRQVVDDTKYKDYQQVGILHQHNNSGFVGYLAPTMREGQAYPANFPYPLIGKTAVDSITQKKFLCDRTLWRIPFSSNFMSMGALTDLGQNLLYANSAHALDMTFEVDPMDEPTLLYVLFEVFDVVRVHQPHRGVIETVYLRTPFSAGNATT

SEQ ID NO: 137 - DNA, 35938 bp, Human adenovirus 5
catcatcaataatataccttattttggattgaagccaatatgataatgagggggtggagtttgtgacgtggcgcggggcgtgggaacggggcgggtgacgtagtagtgtggcggaagtgtgatgttgcaagtgtggcggaacacatgtaagcgacggatgtggcaaaagtgacgtttttggtgtgcgccggtgtacacaggaagtgacaattttcgcgcggttttaggcggatgttgtagtaaatttgggcgtaaccgagtaagatttggccattttcgcgggaaaactgaataagaggaagtgaaatctgaataattttgtgttactcatagcgcgtaatatttgtctagggccgcggggactttgaccgtttacgtggagactcgcccaggtgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctgataatcttccacctcctagccattttgaaccacctacccttcacgaactgtatgatttagacgtgacggcccccgaagatcccaacgaggaggcggtttcgcagatttttcccgactctgtaatgttggcggtgcaggaagggattgacttactcacttttccgccggcgcccggttctccggagccgcctcacctttcccggcagcccgagcagccggagcagagagccttgggtccggtttctatgccaaaccttgtaccggaggtgatcgatcttacctgccacgaggctggctttccacccagtgacgacgaggatgaagagggtgaggagtttgtgttagattatgtggagcaccccgggcacggttgcaggtcttgtcattatcaccggaggaatacgggggacccagatattatgtgttcgctttgctatatgaggacctgtggcatgtttgtctacagtaagtgaaaattatgggcagtgggtgatagagtggtgggtttggtgtggtaattttttttttaatttttacagttttgtggtttaaagaattttgtattgtgatttttttaaaaggtcctgtgtctgaacctgagcctgagcccgagccagaaccggagcctgcaagacctacccgccgtcctaaaatggcgcctgctatcctgagacgcccgacatcacctgtgtctagagaatgcaatagtagtacggatagctgtgactccggtccttctaacacacctcctgagatacacccggtggtcccgctgtgccccattaaaccagttgccgtgagagttggtgggcgtcgccaggctgtggaatgtatcgaggacttgcttaacgagcctgggcaacctttggacttgagctgtaaacgccccaggccataaggtgtaaacctgtgattgcgtgtgtggttaacgcctttgtttgctgaatgagttgatgtaagtttaataaagggtgagataatgtttaacttgcatggcgtgttaaatggggcggggcttaaagggtatataatgcgccgtgggctaatcttggttacatctgacctcatggaggcttgggagtgtttggaagatttttctgctgtgcgtaacttgctggaacagagctctaacagtacctcttggttttggaggtttctgtggggctcatcccaggcaaagttagtctgcagaattaaggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataaatggagcgaagaaacccatctgagcggggggtacctgctggattttctggccatgcatctgtggagagcggttgtgagacacaagaatcgcctgctactgttgtcttccgtccgcccggcgataataccgacggaggagcagcagcagcagcaggaggaagccaggcggcggcggcaggagcagagcccatggaacccgagagccggcctggaccctcgggaatgaatgttgtacaggtggctgaactgtatccagaactgagacgcattttgacaattacagaggatgggcaggggctaaagggggtaaagagggagcggggggcttgtgaggctacagaggaggctaggaatctagcttttagcttaatgaccagacaccgtcctgagtgtattacttttcaacagatcaaggataattgcgctaatgagcttgatctgctggcgcagaagtattccatagagcagctgaccacttactggctgcagccaggggatgattttgaggaggctattagggtatatgcaaaggtggcacttaggccagattgcaagtacaagatcagcaaacttgtaaatatcaggaattgttgctacatttctgggaacggggccgaggtggagatagatacggaggatagggtggcctttagatgtagcatgataaatatgtggccgggggtgcttggcatggacggggtggttattatgaatgtaaggtttactggccccaattttagcggtacggttttcctggccaataccaaccttatcctacacggtgtaagcttctatgggtttaacaatacctgtgtggaagcctggaccgatgtaagggttcggggctgtgccttttactgctgctggaagggggtggtgtgtcgccccaaaagcagggcttcaattaagaaatgcctctttgaaaggtgtaccttgggtatcctgtctgagggtaactccagggtgcgccacaatgtggcctccgactgtggttgcttcatgctagtgaaaagcgtggctgtgattaagcataacatggtatgtggcaactgcgaggacagggcctctcagatgctgacctgctcggacggcaactgtcacctgctgaagaccattcacgtagccagccactctcgcaaggcctggccagtgtttgagcataacatactgacccgctgttccttgcatttgggtaacaggaggggggtgttcctaccttaccaatgcaatttgagtcacactaagatattgcttgagcccgagagcatgtccaaggtgaacctgaacggggtgtttgacatgaccatgaagatctggaaggtgctgaggtacgatgagacccgcaccaggtgcagaccctgcgagtgtggcggtaaacatattaggaaccagcctgtgatgctggatgtgaccgaggagctgaggcccgatcacttggtgctggcctgcacccgcgctgagtttggctctagcgatgaagatacagattgaggtactgaaatgtgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgatgggctccagcattgatggtcgccccgtcctgcccgcaaactctactaccttgacctacgagaccgtgtctggaacgccgttggagactgcagcctccgccgccgcttcagccgctgcagccaccgcccgcgggattgtgactgactttgctttcctgagcccgcttgcaagcagtgcagcttcccgttcatccgcccgcgatgacaagttgacggctcttttggcacaattggattctttgacccgggaacttaatgtcgtttctcagcagctgttggatctgcgccagcaggtttctgccctgaaggcttcctcccctcccaatgcggtttaaaacataaataaaaaaccagactctgtttggatttggatcaagcaagtgtcttgctgtctttatttaggggttttgcgcgcgcggtaggcccgggaccagcggtctcggtcgttgagggtcctgtgtattttttccaggacgtggtaaaggtgactctggatgttcagatacatgggcataagcccgtctctggggtggaggtagcaccactgcagagcttcatgctgcggggtggtgttgtagatgatccagtcgtagcaggagcgctgggcgtggtgcctaaaaatgtctttcagtagcaagctgattgccaggggcaggcccttggtgtaagtgtttacaaagcggttaagctgggatgggtgcatacgtggggatatgagatgcatcttggactgtatttttaggttggctatgttcccagccatatccctccggggattcatgttgtgcagaaccaccagcacagtgtatccggtgcacttgggaaatttgtcatgtagcttagaaggaaatgcgtggaagaacttggagacgcccttgtgacctccaagattttccatgcattcgtccataatgatggcaatgggcccacgggcggcggcctgggcgaagatatttctgggatcactaacgtcatagttgtgttccaggatgagatcgtcataggccatttttacaaagcgcgggcggagggtgccagactgcggtataatggttccatccggcccaggggcgtagttaccctcacagatttgcatttcccacgctttgagttcagatggggggatcatgtctacctgcggggcgatgaagaaaacggtttccggggtaggggagatcagctgggaagaaagcaggttcctgagcagctgcgacttaccgcagccggtgggcccgtaaatcacacctattaccgggtgcaactggtagttaagagagctgcagctgccgtcatccctgagcaggggggccacttcgttaagcatgtccctgactcgcatgttttccctgaccaaatccgccagaaggcgctcgccgcccagcgatagcagttcttgcaaggaagcaaagtttttcaacggtttgagaccgtccgccgtaggcatgcttttgagcgtttgaccaagcagttccaggcggtcccacagctcggtcacctgctctacggcatctcgatccagcatatctcctcgtttcgcgggttggggcggctttcgctgtacggcagtagtcggtgctcgtccagacgggccagggtcatgtctttccacgggcgcagggtcctcgtcagcgtagtctgggtcacggtgaaggggtgcgctccgggctgcgcgctggccagggtgcgcttgaggctggtcctgctggtgctgaagcgctgccggtcttcgccctgcgcgtcggccaggtagcatttgaccatggtgtcatagtccagcccctccgcggcgtggcccttggcgcgcagcttgcccttggaggaggcgccgcacgaggggcagtgcagacttttgagggcgtagagcttgggcgcgagaaataccgattccggggagtaggcatccgcgccgcaggccccgcagacggtctcgcattccacgagccaggtgagctctggccgttcggggtcaaaaaccaggtttcccccatgctttttgatgcgtttcttacctctggtttccatgagccggtgtccacgctcggtgacgaaaaggctgtccgtgtccccgtatacagacttgagaggcctgtcctcgagcggtgttccgcggtcctcctcgtatagaaactcggaccactctgagacaaaggctcgcgtccaggccagcacgaaggaggctaagtgggaggggtagcggtcgttgtccactagggggtccactcgctccagggtgtgaagacacatgtcgccctcttcggcatcaaggaaggtgattggtttgtaggtgtaggccacgtgaccgggtgttcctgaaggggggctataaaagggggtgggggcgcgttcgtcctcactctcttccgcatcgctgtctgcgagggccagctgttggggtgagtactccctctgaaaagcgggcatgacttctgcgctaagattgtcagtttccaaaaacgaggaggatttgatattcacctggcccgcggtgatgcctttgagggtggccgcatccatctggtcagaaaagacaatctttttgttgtcaagcttggtggcaaacgacccgtagagggcgttggacagcaacttggcgatggagcgcagggtttggtttttgtcgcgatcggcgcgctccttggccgcgatgtttagctgcacgtattcgcgcgcaacgcaccgccattcgggaaagacggtggtgcgctcgtcgggcaccaggtgcacgcgccaaccgcggttgtgcagggtgacaaggtcaacgctggtggctacctctccgcgtaggcgctcgttggtccagcagaggcggccgcccttgcgcgagcagaatggcggtagggggtctagctgcgtctcgtccggggggtctgcgtccacggtaaagaccccgggcagcaggcgcgcgtcgaagtagtctatcttgcatccttgcaagtctagcgcctgctgccatgcgcgggcggcaagcgcgcgctcgtatgggttgagtgggggaccccatggcatggggtgggtgagcgcggaggcgtacatgccgcaaatgtcgtaaacgtagaggggctctctgagtattccaagatatgtagggtagcatcttccaccgcggatgctggcgcgcacgtaatcgtatagttcgtgcgagggagcgaggaggtcgggaccgaggttgctacgggcgggctgctctgctcggaagactatctgcctgaagatggcatgtgagttggatgatatggttggacgctggaagacgttgaagctggcgtctgtgagacctaccgcgtcacgcacgaaggaggcgtaggagtcgcgcagcttgttgaccagctcggcggtgacctgcacgtctagggcgcagtagtccagggtttccttgatgatgtcatacttatcctgtcccttttttttccacagctcgcggttgaggacaaactcttcgcggtctttccagtactcttggatcggaaacccgtcggcctccgaacggtaagagcctagcatgtagaactggttgacggcctggtaggcgcagcatcccttttctacgggtagcgcgtatgcctgcgcggccttccggagcgaggtgtgggtgagcgcaaaggtgtccctgaccatgactttgaggtactggtatttgaagtcagtgtcgtcgcatccgccctgctcccagagcaaaaagtccgtgcgctttttggaacgcggatttggcagggcgaaggtgacatcgttgaagagtatctttcccgcgcgaggcataaagttgcgtgtgatgcggaagggtcccggcacctcggaacggttgttaattacctgggcggcgagcacgatctcgtcaaagccgttgatgttgtggcccacaatgtaaagttccaagaagcgcgggatgcccttgatggaaggcaattttttaagttcctcgtaggtgagctcttcaggggagctgagcccgtgctctgaaagggcccagtctgcaagatgagggttggaagcgacgaatgagctccacaggtcacgggccattagcatttgcaggtggtcgcgaaaggtcctaaactggcgacctatggccattttttctggggtgatgcagtagaaggtaagcgggtcttgttcccagcggtcccatccaaggttcgcggctaggtctcgcgcggcagtcactagaggctcatctccgccgaacttcatgaccagcatgaagggcacgagctgcttcccaaaggcccccatccaagtataggtctctacatcgtaggtgacaaagagacgctcggtgcgaggatgcgagccgatcgggaagaactggatctcccgccaccaattggaggagtggctattgatgtggtgaaagtagaagtccctgcgacgggccgaacactcgtgctggcttttgtaaaaacgtgcgcagtactggcagcggtgcacgggctgtacatcctgcacgaggttgacctgacgaccgcgcacaaggaagcagagtgggaatttgagcccctcgcctggcgggtttggctggtggtcttctacttcggctgcttgtccttgaccgtctggctgctcgaggggagttacggtggatcggaccaccacgccgcgcgagcccaaagtccagatgtccgcgcgcggcggtcggagcttgatgacaacatcgcgcagatgggagctgtccatggtctggagctcccgcggcgtcaggtcaggcgggagctcctgcaggtttacctcgcatagacgggtcagggcgcgggctagatccaggtgatacctaatttccaggggctggttggtggcggcgtcgatggcttgcaagaggccgcatccccgcggcgcgactacggtaccgcgcggcgggcggtgggccgcgggggtgtccttggatgatgcatctaaaagcggtgacgcgggcgagcccccggaggtagggggggctccggacccgccgggagagggggcaggggcacgtcggcgccgcgcgcgggcaggagctggtgctgcgcgcgtaggttgctggcgaacgcgacgacgcggcggttgatctcctgaatctggcgcctctgcgtgaagacgacgggcccggtgagcttgagcctgaaagagagttcgacagaatcaatttcggtgtcgttgacggcggcctggcgcaaaatctcctgcacgtctcctgagttgtcttgataggcgatctcggccatgaactgctcgatctcttcctcctggagatctccgcgtccggctcgctccacggtggcggcgaggtcgttggaaatgcgggccatgagctgcgagaaggcgttgaggcctccctcgttccagacgcggctgtagaccacgcccccttcggcatcgcgggcgcgcatgaccacctgcgcgagattgagctccacgtgccgggcgaagacggcgtagtttcgcaggcgctgaaagaggtagttgagggtggtggcggtgtgttctgccacgaagaagtacataacccagcgtcgcaacgtggattcgttgatatcccccaaggcctcaaggcgctccatggcctcgtagaagtccacggcgaagttgaaaaactgggagttgcgcgccgacacggttaactcctcctccagaagacggatgagctcggcgacagtgtcgcgcacctcgcgctcaaaggctacaggggcctcttcttcttcttcaatctcctcttccataagggcctccccttcttcttcttctggcggcggtgggggaggggggacacggcggcgacgacggcgcaccgggaggcggtcgacaaagcgctcgatcatctccccgcggcgacggcgcatggtctcggtgacggcgcggccgttctcgcgggggcgcagttggaagacgccgcccgtcatgtcccggttatgggttggcggggggctgccatgcggcagggatacggcgctaacgatgcatctcaacaattgttgtgtaggtactccgccgccgagggacctgagcgagtccgcatcgaccggatcggaaaacctctcgagaaaggcgtctaaccagtcacagtcgcaaggtaggctgagcaccgtggcgggcggcagcgggcggcggtcggggttgtttctggcggaggtgctgctgatgatgtaattaaagtaggcggtcttgagacggcggatggtcgacagaagcaccatgtccttgggtccggcctgctgaatgcgcaggcggtcggccatgccccaggcttcgttttgacatcggcgcaggtctttgtagtagtcttgcatgagcctttctaccggcacttcttcttctccttcctcttgtcctgcatctcttgcatctatcgctgcggcggcggcggagtttggccgtaggtggcgccctcttcctcccatgcgtgtgaccccgaagcccctcatcggctgaagcagggctaggtcggcgacaacgcgctcggctaatatggcctgctgcacctgcgtgagggtagactggaagtcatccatgtccacaaagcggtggtatgcgcccgtgttgatggtgtaagtgcagttggccataacggaccagttaacggtctggtgacccggctgcgagagctcggtgtacctgagacgcgagtaagccctcgagtcaaatacgtagtcgttgcaagtccgcaccaggtactggtatcccaccaaaaagtgcggcggcggctggcggtagaggggccagcgtagggtggccggggctccgggggcgagatcttccaacataaggcgatgatatccgtagatgtacctggacatccaggtgatgccggcggcggtggtggaggcgcgcggaaagtcgcggacgcggttccagatgttgcgcagcggcaaaaagtgctccatggtcgggacgctctggccggtcaggcgcgcgcaatcgttgacgctctagaccgtgcaaaaggagagcctgtaagcgggcactcttccgtggtctggtggataaattcgcaagggtatcatggcggacgaccggggttcgagccccgtatccggccgtccgccgtgatccatgcggttaccgcccgcgtgtcgaacccaggtgtgcgacgtcagacaacgggggagtgctccttttggcttccttccaggcgcggcggctgctgcgctagcttttttggccactggccgcgcgcagcgtaagcggttaggctggaaagcgaaagcattaagtggctcgctccctgtagccggagggttattttccaagggttgagtcgcgggacccccggttcgagtctcggaccggccggactgcggcgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcctcctaccgcgtcaggaggggcgacatccgcggttgacgcggcagcagatggtgattacgaacccccgcggcgccgggcccggcactacctggacttggaggagggcgagggcctggcgcggctaggagcgccctctcctgagcggtacccaagggtgcagctgaagcgtgatacgcgtgaggcgtacgtgccgcggcagaacctgtttcgcgaccgcgagggagaggagcccgaggagatgcgggatcgaaagttccacgcagggcgcgagctgcggcatggcctgaatcgcgagcggttgctgcgcgaggaggactttgagcccgacgcgcgaaccgggattagtcccgcgcgcgcacacgtggcggccgccgacctggtaaccgcatacgagcagacggtgaaccaggagattaactttcaaaaaagctttaacaaccacgtgcgtacgcttgtggcgcgcgaggaggtggctataggactgatgcatctgtgggactttgtaagcgcgctggagcaaaacccaaatagcaagccgctcatggcgcagctgttccttatagtgcagcacagcagggacaacgaggcattcagggatgcgctgctaaacatagtagagcccgagggccgctggctgctcgatttgataaacatcctgcagagcatagtggtgcaggagcgcagcttgagcctggctgacaaggtggccgccatcaactattccatgcttagcctgggcaagttttacgcccgcaagatataccataccccttacgttcccatagacaaggaggtaaagatcgaggggttctacatgcgcatggcgctgaaggtgcttaccttgagcgacgacctgggcgtttatcgcaacgagcgcatccacaaggccgtgagcgtgagccggcggcgcgagctcagcgaccgcgagctgatgcacagcctgcaaagggccctggctggcacgggcagcggcgatagagaggccgagtcctactttgacgcgggcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagatgatgcaagacgcaacggacccggcggtgcgggcggcgctgcagagccagccgtccggccttaactccacggacgactggcgccaggtcatggaccgcatcatgtcgctgactgcgcgcaatcctgacgcgttccggcagcagccgcaggccaaccggctctccgcaattctggaagcggtggtcccggcgcgcgcaaaccccacgcacgagaaggtgctggcgatcgtaaacgcgctggccgaaaacagggccatccggcccgacgaggccggcctggtctacgacgcgctgcttcagcgcgtggctcgttacaacagcggcaacgtgcagaccaacctggaccggctggtgggggatgtgcgcgaggccgtggcgcagcgtgagcgcgcgcagcagcagggcaacctgggctccatggttgcactaaacgccttcctgagtacacagcccgccaacgtgccgcggggacaggaggactacaccaactttgtgagcgcactgcggctaatggtgactgagacaccgcaaagtgaggtgtaccagtctgggccagactattttttccagaccagtagacaaggcctgcagaccgtaaacctgagccaggctttcaaaaacttgcaggggctgtggggggtgcgggctcccacaggcgaccgcgcgaccgtgtctagcttgctgacgcccaactcgcgcctgttgctgctgctaatagcgcccttcacggacagtggcagcgtgtcccgggacacatacctaggtcacttgctgacactgtaccgcgaggccataggtcaggcgcatgtggacgagcatactttccaggagattacaagtgtcagccgcgcgctggggcaggaggacacgggcagcctggaggcaaccctaaactacctgctgaccaaccggcggcagaagatcccctcgttgcacagtttaaacagcgaggaggagcgcattttgcgctacgtgcagcagagcgtgagccttaacctgatgcgcgacggggtaacgcccagcgtggcgctggacatgaccgcgcgcaacatggaaccgggcatgtatgcctcaaaccggccgtttatcaaccgcctaatggactacttgcatcgcgcggccgccgtgaaccccgagtatttcaccaatgccatcttgaacccgcactggctaccgccccctggtttctacaccgggggattcgaggtgcccgagggtaacgatggattcctctgggacgacatagacgacagcgtgttttccccgcaaccgcagaccctgctagagttgcaacagcgcgagcaggcagaggcggcgctgcgaaaggaaagcttccgcaggccaagcagcttgtccgatctaggcgctgcggccccgcggtcagatgctagtagcccatttccaagcttgatagggtctcttaccagcactcgcaccacccgcccgcgcctgctgggcgaggaggagtacctaaacaactcgctgctgcagccgcagcgcgaaaaaaacctgcctccggcatttcccaacaacgggatagagagcctagtggacaagatgagtagatggaagacgtacgcgcaggagcacagggacgtgccaggcccgcgcccgcccacccgtcgtcaaaggcacgaccgtcagcggggtctggtgtgggaggacgatgactcggcagacgacagcagcgtcctggatttgggagggagtggcaacccgtttgcgcaccttcgccccaggctggggagaatgttttaaaaaaaaaaaagcatgatgcaaaataaaaaactcaccaaggccatggcaccgagcgttggttttcttgtattccccttagtatgcggcgcgcggcgatgtatgaggaaggtcctcctccctcctacgagagtgtggtgagcgcggcgccagtggcggcggcgctgggttctcccttcgatgctcccctggacccgccgtttgtgcctccgcggtacctgcggcctaccggggggagaaacagcatccgttactctgagttggcacccctattcgacaccacccgtgtgtacctggtggacaacaagtcaacggatgtggcatccctgaactaccagaacgaccacagcaactttctgaccacggtcattcaaaacaatgactacagcccgggggaggcaagcacacagaccatcaatcttgacgaccggtcgcactggggcggcgacctgaaaaccatcctgcataccaacatgccaaatgtgaacgagttcatgtttaccaataagtttaaggcgcgggtgatggtgtcgcgcttgcctactaaggacaatcaggtggagctgaaatacgagtgggtggagttcacgctgcccgagggcaactactccgagaccatgaccatagaccttatgaacaacgcgatcgtggagcactacttgaaagtgggcagacagaacggggttctggaaagcgacatcggggtaaagtttgacacccgcaacttcagactggggtttgaccccgtcactggtcttgtcatgcctggggtatatacaaacgaagccttccatccagacatcattttgctgccaggatgcggggtggacttcacccacagccgcctgagcaacttgttgggcatccgcaagcggcaacccttccaggagggctttaggatcacctacgatgatctggagggtggtaacattcccgcactgttggatgtggacgcctaccaggcgagcttgaaagatgacaccgaacagggcgggggtggcgcaggcggcagcaacagcagtggcagcggcgcggaagagaactccaacgcggcagccgcggcaatgcagccggtggaggacatgaacgatcatgccattcgcggcgacacctttgccacacgggctgaggagaagcgcgctgaggccgaagcagcggccgaagctgccgcccccgctgcgcaacccgaggtcgagaagcctcagaagaaaccggtgatcaaacccctgacagaggacagcaagaaacgcagttacaacctaataagcaatgacagcaccttcacccagtaccgcagctggtaccttgcatacaactacggcgaccctcagaccggaatccgctcatggaccctgctttgcactcctgacgtaacctgcggctcggagcaggtctactggtcgttgccagacatgatgcaagaccccgtgaccttccgctccacgcgccagatcagcaactttccggtggtgggcgccgagctgttgcccgtgcactccaagagcttctacaacgaccaggccgtctactcccaactcatccgccagtttacctctctgacccacgtgttcaatcgctttcccgagaaccagattttggcgcgcccgccagcccccaccatcaccaccgtcagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctccgaccaacacccagtgcgcgtgcgcgggcactaccgcgcgccctggggcgcgcacaaacgcggccgcactgggcgcaccaccgtcgatgacgccatcgacgcggtggtggaggaggcgcgcaactacacgcccacgccgccaccagtgtccacagtggacgcggccattcagaccgtggtgcgcggagcccggcgctatgctaaaatgaagagacggcggaggcgcgtagcacgtcgccaccgccgccgacccggcactgccgcccaacgcgcggcggcggccctgcttaaccgcgcacgtcgcaccggccgacgggcggccatgcgggccgctcgaaggctggccgcgggtattgtcactgtgccccccaggtccaggcgacgagcggccgccgcagcagccgcggccattagtgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctatgtccaagcgcaaaatcaaagaagagatgctccaggtcatcgcgccggagatctatggccccccgaagaaggaagagcaggattacaagccccgaaagctaaagcgggtcaaaaagaaaaagaaagatgatgatgatgaacttgacgacgaggtggaactgctgcacgctaccgcgcccaggcgacgggtacagtggaaaggtcgacgcgtaaaacgtgttttgcgacccggcaccaccgtagtctttacgcccggtgagcgctccacccgcacctacaagcgcgtgtatgatgaggtgtacggcgacgaggacctgcttgagcaggccaacgagcgcctcggggagtttgcctacggaaagcggcataaggacatgctggcgttgccgctggacgagggcaacccaacacctagcctaaagcccgtaacactgcagcaggtgctgcccgcgcttgcaccgtccgaagaaaagcgcggcctaaagcgcgagtctggtgacttggcacccaccgtgcagctgatggtacccaagcgccagcgactggaagatgtcttggaaaaaatgaccgtggaacctgggctggagcccgaggtccgcgtgcggccaatcaagcaggtggcgccgggactgggcgtgcagaccgtggacgttcagatacccactaccagtagcaccagtattgccaccgccacagagggcatggagacacaaacgtccccggttgcctcagcggtggcggatgccgcggtgcaggcggtcgctgcggccgcgtccaagacctctacggaggtgcaaacggacccgtggatgtttcgcgtttcagccccccggcgcccgcgcggttcgaggaagtacggcgccgccagcgcgctactgcccgaatatgccctacatccttccattgcgcctacccccggctatcgtggctacacctaccgccccagaagacgagcaactacccgacgccgaaccaccactggaacccgccgccgccgtcgccgtcgccagcccgtgctggccccgatttccgtgcgcagggtggctcgcgaaggaggcaggaccctggtgctgccaacagcgcgctaccaccccagcatcgtttaaaagccggtctttgtggttcttgcagatatggccctcacctgccgcctccgtttcccggtgccgggattccgaggaagaatgcaccgtaggaggggcatggccggccacggcctgacgggcggcatgcgtcgtgcgcaccaccggcggcggcgcgcgtcgcaccgtcgcatgcgcggcggtatcctgcccctccttattccactgatcgccgcggcgattggcgccgtgcccggaattgcatccgtggccttgcaggcgcagagacactgattaaaaacaagttgcatgtggaaaaatcaaaataaaaagtctggactctcacgctcgcttggtcctgtaactattttgtagaatggaagacatcaactttgcgtctctggccccgcgacacggctcgcgcccgttcatgggaaactggcaagatatcggcaccagcaatatgagcggtggcgccttcagctggggctcgctgtggagcggcattaaaaatttcggttccaccgttaagaactatggcagcaaggcctggaacagcagcacaggccagatgctgagggataagttgaaagagcaaaatttccaacaaaaggtggtagatggcctggcctctggcattagcggggtggtggacctggccaaccaggcagtgcaaaataagattaacagtaagcttgatccccgccctcccgtagaggagcctccaccggccgtggagacagtgtctccagaggggcgtggcgaaaagcgtccgcgccccgacagggaagaaactctggtgacgcaaatagacgagcctccctcgtacgaggaggcactaaagcaaggcctgcccaccacccgtcccatcgcgcccatggctaccggagtgctgggccagcacacacccgtaacgctggacctgcctccccccgccgacacccagcagaaacctgtgctgccaggcccgaccgccgttgttgtaacccgtcctagccgcgcgtccctgcgccgcgccgccagcggtccgcgatcgttgcggcccgtagccagtggcaactggcaaagcacactgaacagcatcgtgggtctgggggtgcaatccctgaagcgccgacgatgcttctgaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcagtttgcccgcgccaccgagacgtacttcagcctgaataacaagtttagaaaccccacggtggcgcctacgcacgacgtgaccacagaccggtcccagcgtttgacgctgcggttcatccctgtggaccgtgaggatactgcgtactcgtacaaggcgcggttcaccctagctgtgggtgataaccgtgtgctggacatggcttccacgtactttgacatccgcggcgtgctggacaggggccctacttttaagccctactctggcactgcctacaacgccctggctcccaagggtgccccaaatccttgcgaatgggatgaagctgctactgctcttgaaataaacctagaagaagaggacgatgacaacgaagacgaagtagacgagcaagctgagcagcaaaaaactcacgtatttgggcaggcgccttattctggtataaatattacaaaggagggtattcaaataggtgtcgaaggtcaaacacctaaatatgccgataaaacatttcaacctgaacctcaaataggagaatctcagtggtacgaaactgaaattaatcatgcagctgggagagtccttaaaaagactaccccaatgaaaccatgttacggttcatatgcaaaacccacaaatgaaaatggagggcaaggcattcttgtaaagcaacaaaatggaaagctagaaagtcaagtggaaatgcaatttttctcaactactgaggcgaccgcaggcaatggtgataacttgactcctaaagtggtattgtacagtgaagatgtagatatagaaaccccagacactcatatttcttacatgcccactattaaggaaggtaactcacgagaactaatgggccaacaatctatgcccaacaggcctaattacattgcttttagggacaattttattggtctaatgtattacaacagcacgggtaatatgggtgttctggcgggccaagcatcgcagttgaatgctgttgtagatttgcaagacagaaacacagagctttcataccagcttttgcttgattccattggtgatagaaccaggtacttttctatgtggaatcaggctgttgacagctatgatccagatgttagaattattgaaaatcatggaactgaagatgaacttccaaattactgctttccactgggaggtgtgattaatacagagactcttaccaaggtaaaacctaaaacaggtcaggaaaatggatgggaaaaagatgctacagaattttcagataaaaatgaaataagagttggaaataattttgccatggaaatcaatctaaatgccaacctgtggagaaatttcctgtactccaacatagcgctgtatttgcccgacaagctaaagtacagtccttccaacgtaaaaatttctgataacccaaacacctacgactacatgaacaagcgagtggtggctcccgggttagtggactgctacattaaccttggagcacgctggtcccttgactatatggacaacgtcaacccatttaaccaccaccgcaatgctggcctgcgctaccgctcaatgttgctgggcaatggtcgctatgtgcccttccacatccaggtgcctcagaagttctttgccattaaaaacctccttctcctgccgggctcatacacctacgagtggaacttcaggaaggatgttaacatggttctgcagagctccctaggaaatgacctaagggttgacggagccagcattaagtttgatagcatttgcctttacgccaccttcttccccatggcccacaacaccgcctccacgcttgaggccatgcttagaaacgacaccaacgaccagtcctttaacgactatctctccgccgccaacatgctctaccctatacccgccaacgctaccaacgtgcccatatccatcccctcccgcaactgggcggctttccgcggctgggccttcacgcgccttaagactaaggaaaccccatcactgggctcgggctacgacccttattacacctactctggctctataccctacctagatggaaccttttacctcaaccacacctttaagaaggtggccattacctttgactcttctgtcagctggcctggcaatgaccgcctgcttacccccaacgagtttgaaattaagcgctcagttgacggggagggttacaacgttgcccagtgtaacatgaccaaagactggttcctggtacaaatgctagctaactacaacattggctaccagggcttctatatcccagagagctacaaggaccgcatgtactccttctttagaaacttccagcccatgagccgtcaggtggtggatgatactaaatacaaggactaccaacaggtgggcatcctacaccaacacaacaactctggatttgttggctaccttgcccccaccatgcgcgaaggacaggcctaccctgctaacttcccctatccgcttataggcaagaccgcagttgacagcattacccagaaaaagtttctttgcgatcgcaccctttggcgcatcccattctccagtaactttatgtccatgggcgcactcacagacctgggccaaaaccttctctacgccaactccgcccacgcgctagacatgacttttgaggtggatcccatggacgagcccacccttctttatgttttgtttgaagtctttgacgtggtccgtgtgcaccggccgcaccgcggcgtcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttccaggctttgtttctccacacaagctcgcctgcgccatagtcaatacggccggtcgcgagactgggggcgtacactggatggcctttgcctggaacccgcactcaaaaacatgctacctctttgagccctttggcttttctgaccagcgactcaagcaggtttaccagtttgagtacgagtcactcctgcgccgtagcgccattgcttcttcccccgaccgctgtataacgctggaaaagtccacccaaagcgtacaggggcccaactcggccgcctgtggactattctgctgcatgtttctccacgcctttgccaactggccccaaactcccatggatcacaaccccaccatgaaccttattaccggggtacccaactccatgctcaacagtccccaggtacagcccaccctgcgtcgcaaccaggaacagctctacagcttcctggagcgccactcgccctacttccgcagccacagtgcgcagattaggagcgccacttctttttgtcacttgaaaaacatgtaaaaataatgtactagagacactttcaataaaggcaaatgcttttatttgtacactctcgggtgattatttacccccacccttgccgtctgcgccgtttaaaaatcaaaggggttctgccgcgcatcgctatgcgccactggcagggacacgttgcgatactggtgtttagtgctccacttaaactcaggcacaaccatccgcggcagctcggtgaagttttcactccacaggctgcgcaccatcaccaacgcgtttagcaggtcgggcgccgatatcttgaagtcgcagttggggcctccgccctgcgcgcgcgagttgcgatacacagggttgcagcactggaacactatcagcgccgggtggtgcacgctggccagcacgctcttgtcggagatcagatccgcgtccaggtcctccgcgttgctcagggcgaacggagtcaactttggtagctgccttcccaaaaagggcgcgtgcccaggctttgagttgcactcgcaccgtagtggcatcaaaaggtgaccgtgcccggtctgggcgttaggatacagcgcctgcataaaagccttgatctgcttaaaagccacctgagcctttgcgccttcagagaagaacatgccgcaagacttgccggaaaactgattggccggacaggccgcgtcgtgcacgcagcaccttgcgtcggtgttggagatctgcaccacatttcggccccaccggttcttcacgatcttggccttgctagactgctccttcagcgcgcgctgcccgttttcgctcgtcacatccatttcaatcacgtgctccttatttatcataatgcttccgtgtagacacttaagctcgccttcgatctcagcgcagcggtgcagccacaacgcgcagcccgtgggctcgtgatgcttgtaggtcacctctgcaaacgactgcaggtacgcctgcaggaatcgccccatcatcgtcacaaaggtcttgttgctggtgaaggtcagctgcaacccgcggtgctcctcgttcagccaggtcttgcatacggccgccagagcttccacttggtcaggcagtagtttgaagttcgcctttagatcgttatccacgtggtacttgtccatcagcgcgcgcgcagcctccatgcccttctcccacgcagacacgatcggcacactcagcgggttcatcaccgtaatttcactttccgcttcgctgggctcttcctcttcctcttgcgtccgcataccacgcgccactgggtcgtcttcattcagccgccgcactgtgcgcttacctcctttgccatgcttgattagcaccggtgggttgctgaaacccaccatttgtagcgccacatcttctctttcttcctcgctgtccacgattacctctggtgatggcgggcgctcgggcttgggagaagggcgcttctttttcttcttgggcgcaatggccaaatccgccgccgaggtcgatggccgcgggctgggtgtgcgcggcaccagcgcgtcttgtgatgagtcttcctcgtcctcggactcgatacgccgcctcatccgcttttttgggggcgcccggggaggcggcggcgacggggacggggacgacacgtcctccatggttgggggacgtcgcgccgcaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctaccaccttccccgtcgaggcacccccgcttgaggaggaggaagtgattatcgagcaggacccaggttttgtaagcgaagacgacgaggaccgctcagtaccaacagaggataaaaagcaagaccaggacaacgcagaggcaaacgaggaacaagtcgggcggggggacgaaaggcatggcgactacctagatgtgggagacgacgtgctgttgaagcatctgcagcgccagtgcgccattatctgcgacgcgttgcaagagcgcagcgatgtgcccctcgccatagcggatgtcagccttgcctacgaacgccacctattctcaccgcgcgtaccccccaaacgccaagaaaacggcacatgcgagcccaacccgcgcctcaacttctaccccgtatttgccgtgccagaggtgcttgccacctatcacatctttttccaaaactgcaagatacccctatcctgccgtgccaaccgcagccgagcggacaagcagctggccttgcggcagggcgctgtcatacctgatatcgcctcgctcaacgaagtgccaaaaatctttgagggtcttggacgcgacgagaagcgcgcggcaaacgctctgcaacaggaaaacagcgaaaatgaaagtcactctggagtgttggtggaactcgagggtgacaacgcgcgcctagccgtactaaaacgcagcatcgaggtcacccactttgcctacccggcacttaacctaccccccaaggtcatgagcacagtcatgagtgagctgatcgtgcgccgtgcgcagcccctggagagggatgcaaatttgcaagaacaaacagaggagggcctacccgcagttggcgacgagcagctagcgcgctggcttcaaacgcgcgagcctgccgacttggaggagcgacgcaaactaatgatggccgcagtgctcgttaccgtggagcttgagtgcatgcagcggttctttgctgacccggagatgcagcgcaagctagaggaaacattgcactacacctttcgacagggctacgtacgccaggcctgcaagatctccaacgtggagctctgcaacctggtctcctaccttggaattttgcacgaaaaccgccttgggcaaaacgtgcttcattccacgctcaagggcgaggcgcgccgcgactacgtccgcgactgcgtttacttatttctatgctacacctggcagacggccatgggcgtttggcagcagtgcttggaggagtgcaacctcaaggagctgcagaaactgctaaagcaaaacttgaaggacctatggacggccttcaacgagcgctccgtggccgcgcacctggcggacatcattttccccgaacgcctgcttaaaaccctgcaacagggtctgccagacttcaccagtcaaagcatgttgcagaactttaggaactttatcctagagcgctcaggaatcttgcccgccacctgctgtgcacttcctagcgactttgtgcccattaagtaccgcgaatgccctccgccgctttggggccactgctaccttctgcagctagccaactaccttgcctaccactctgacataatggaagacgtgagcggtgacggtctactggagtgtcactgtcgctgcaacctatgcaccccgcaccgctccctggtttgcaattcgcagctgcttaacgaaagtcaaattatcggtacctttgagctgcagggtccctcgcctgacgaaaagtccgcggctccggggttgaaactcactccggggctgtggacgtcggcttaccttcgcaaatttgtacctgaggactaccacgcccacgagattaggttctacgaagaccaatcccgcccgccaaatgcggagcttaccgcctgcgtcattacccagggccacattcttggccaattgcaagccatcaacaaagcccgccaagagtttctgctacgaaagggacggggggtttacttggacccccagtccggcgaggagctcaacccaatccccccgccgccgcagccctatcagcagcagccgcgggcccttgcttcccaggatggcacccaaaaagaagctgcagctgccgccgccacccacggacgaggaggaatactgggacagtcaggcagaggaggttttggacgaggaggaggaggacatgatggaagactgggagagcctagacgaggaagcttccgaggtcgaagaggtgtcagacgaaacaccgtcaccctcggtcgcattcccctcgccggcgccccagaaatcggcaaccggttccagcatggctacaacctccgctcctcaggcgccgccggcactgcccgttcgccgacccaaccgtagatgggacaccactggaaccagggccggtaagtccaagcagccgccgccgttagcccaagagcaacaacagcgccaaggctaccgctcatggcgcgggcacaagaacgccatagttgcttgcttgcaagactgtgggggcaacatctccttcgcccgccgctttcttctctaccatcacggcgtggccttcccccgtaacatcctgcattactaccgtcatctctacagcccatactgcaccggcggcagcggcagcggcagcaacagcagcggccacacagaagcaaaggcgaccggatagcaagactctgacaaagcccaagaaatccacagcggcggcagcagcaggaggaggagcgctgcgtctggcgcccaacgaacccgtatcgacccgcgagcttagaaacaggatttttcccactctgtatgctatatttcaacagagcaggggccaagaacaagagctgaaaataaaaaacaggtctctgcgatccctcacccgcagctgcctgtatcacaaaagcgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattatgagcaaggaaattcccacgccctacatgtggagttaccagccacaaatgggacttgcggctggagctgcccaagactactcaacccgaataaactacatgagcgcgggaccccacatgatatcccgggtcaacggaatccgcgcccaccgaaaccgaattctcttggaacaggcggctattaccaccacacctcgtaataaccttaatccccgtagttggcccgctgccctggtgtaccaggaaagtcccgctcccaccactgtggtacttcccagagacgcccaggccgaagttcagatgactaactcaggggcgcagcttgcgggcggctttcgtcacagggtgcggtcgcccgggcagggtataactcacctgacaatcagagggcgaggtattcagctcaacgacgagtcggtgagctcctcgcttggtctccgtccggacgggacatttcagatcggcggcgccggccgtccttcattcacgcctcgtcaggcaatcctaactctgcagacctcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgaatgttaagtggagaggcagagcaactgcgcctgaaacacctggtccactgtcgccgccacaagtgctttgcccgcgactccggtgagttttgctactttgaattgcccgaggatcatatcgagggcccggcgcacggcgtccggcttaccgcccagggagagcttgcccgtagcctgattcgggagtttacccagcgccccctgctagttgagcgggacaggggaccctgtgttctcactgtgatttgcaactgtcctaaccttggattacatcaagatctttgttgccatctctgtgctgagtataataaatacagaaattaaaatatactggggctcctatcgccatcctgtaaacgccaccgtcttcacccgcccaagcaaaccaaggcgaaccttacctggtacttttaacatctctccctctgtgatttacaacagtttcaacccagacggagtgagtctacgagagaacctctccgagctcagctactccatcagaaaaaacaccaccctccttacctgccgggaacgtacgagtgcgtcaccggccgctgcaccacacctaccgcctgaccgtaaaccagactttttccggacagacctcaataactctgtttaccagaacaggaggtgagcttagaaaacccttagggtattaggccaaaggcgcagctactgtggggtttatgaacaattcaagcaactctacgggctattctaattcaggtttctctagaatcggggttggggttattctctgtcttgtgattctctttattcttatactaacgcttctctgcctaaggctcgccgcctgctgtgtgcacatttgcatttattgtcagctttttaaacgctggggtcgccacccaagatgattaggtacataatcctaggtttactcacccttgcgtcagcccacggtaccacccaaaaggtggattttaaggagccagcctgtaatgttacattcgcagctgaagctaatgagtgcaccactcttataaaatgcaccacagaacatgaaaagctgcttattcgccacaaaaacaaaattggcaagtatgctgtttatgctatttggcagccaggtgacactacagagtataatgttacagttttccagggtaaaagtcataaaacttttatgtatacttttccattttatgaaatgtgcgacattaccatgtacatgagcaaacagtataagttgtggcccccacaaaattgtgtggaaaacactggcactttctgctgcactgctatgctaattacagtgctcgctttggtctgtaccctactctatattaaatacaaaagcagacgcagctttattgaggaaaagaaaatgccttaatttactaagttacaaagctaatgtcaccactaactgctttactcgctgcttgcaaaacaaattcaaaaagttagcattataattagaataggatttaaaccccccggtcatttcctgctcaataccattcccctgaacaattgactctatgtgggatatgctccagcgctacaaccttgaagtcaggcttcctggatgtcagcatctgactttggccagcacctgtcccgcggatttgttccagtccaactacagcgacccaccctaacagagatgaccaacacaaccaacgcggccgccgctaccggacttacatctaccacaaatacaccccaagtttctgcctttgtcaataactgggataacttgggcatgtggtggttctccatagcgcttatgtttgtatgccttattattatgtggctcatctgctgcctaaagcgcaaacgcgcccgaccacccatctatagtcccatcattgtgctacacccaaacaatgatggaatccatagattggacggactgaaacacatgttcttttctcttacagtatgattaaatgagacatgattcctcgagtttttatattactgacccttgttgcgcttttttgtgcgtgctccacattggctgcggtttctcacatcgaagtagactgcattccagccttcacagtctatttgctttacggatttgtcaccctcacgctcatctgcagcctcatcactgtggtcatcgcctttatccagtgcattgactgggtctgtgtgcgctttgcatatctcagacaccatccccagtacagggacaggactatagctgagcttcttagaattctttaattatgaaatttactgtgacttttctgctgattatttgcaccctatctgcgttttgttccccgacctccaagcctcaaagacatatatcatgcagattcactcgtatatggaatattccaagttgctacaatgaaaaaagcgatctttccgaagcctggttatatgcaatcatctctgttatggtgttctgcagtaccatcttagccctagctatatatccctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagatgactgacaccctagatctagaaatggacggaattattacagagcagcgcctgctagaaagacgcagggcagcggccgagcaacagcgcatgaatcaagagctccaagacatggttaacttgcaccagtgcaaaaggggtatcttttgtctggtaaagcaggccaaagtcacctacgacagtaataccaccggacaccgccttagctacaagttgccaaccaagcgtcagaaattggtggtcatggtgggagaaaagcccattaccataactcagcactcggtagaaaccgaaggctgcattcactcaccttgtcaaggacctgaggatctctgcacccttattaagaccctgtgcggtctcaaagatcttattccctttaactaataaaaaaaaataataaagcatcacttacttaaaatcagttagcaaatttctgtccagtttattcagcagcacctccttgccctcctcccagctctggtattgcagcttcctcctggctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttactcctccctttgtatcccccaatgggtttcaagagagtccccctggggtactctctttgcgcctatccgaacctctagttacctccaatggcatgcttgcgctcaaaatgggcaacggcctctctctggacgaggccggcaaccttacctcccaaaatgtaaccactgtgagcccacctctcaaaaaaaccaagtcaaacataaacctggaaatatctgcacccctcacagttacctcagaagccctaactgtggctgccgccgcacctctaatggtcgcgggcaacacactcaccatgcaatcacaggccccgctaaccgtgcacgactccaaacttagcattgccacccaaggacccctcacagtgtcagaaggaaagctagccctgcaaacatcaggccccctcaccaccaccgatagcagtacccttactatcactgcctcaccccctctaactactgccactggtagcttgggcattgacttgaaagagcccatttatacacaaaatggaaaactaggactaaagtacggggctcctttgcatgtaacagacgacctaaacactttgaccgtagcaactggtccaggtgtgactattaataatacttccttgcaaactaaagttactggagccttgggttttgattcacaaggcaatatgcaacttaatgtagcaggaggactaaggattgattctcaaaacagacgccttatacttgatgttagttatccgtttgatgctcaaaaccaactaaatctaagactaggacagggccctctttttataaactcagcccacaacttggatattaactacaacaaaggcctttacttgtttacagcttcaaacaattccaaaaagcttgaggttaacctaagcactgccaaggggttgatgtttgacgctacagccatagccattaatgcaggagatgggcttgaatttggttcacctaatgcaccaaacacaaatcccctcaaaacaaaaattggccatggcctagaatttgattcaaacaaggctatggttcctaaactaggaactggccttagttttgacagcacaggtgccattacagtaggaaacaaaaataatgataagctaactttgtggaccacaccagctccatctcctaactgtagactaaatgcagagaaagatgctaaactcactttggtcttaacaaaatgtggcagtcaaatacttgctacagtttcagttttggctgttaaaggcagtttggctccaatatctggaacagttcaaagtgctcatcttattataagatttgacgaaaatggagtgctactaaacaattccttcctggacccagaatattggaactttagaaatggagatcttactgaaggcacagcctatacaaacgctgttggatttatgcctaacctatcagcttatccaaaatctcacggtaaaactgccaaaagtaacattgtcagtcaagtttacttaaacggagacaaaactaaacctgtaacactaaccattacactaaacggtacacaggaaacaggagacacaactccaagtgcatactctatgtcattttcatgggactggtctggccacaactacattaatgaaatatttgccacatcctcttacactttttcatacattgcccaagaataaagaatcgtttgtgttatgtttcaacgtgtttatttttcaattgcagaaaatttcaagtcatttttcattcagtagtatagccccaccaccacatagcttatacagatcaccgtaccttaatcaaactcacagaaccctagtattcaacctgccacctccctcccaacacacagagtacacagtcctttctccccggctggccttaaaaagcatcatatcatgggtaacagacatattcttaggtgttatattccacacggtttcctgtcgagccaaacgctcatcagtgatattaataaactccccgggcagctcacttaagttcatgtcgctgtccagctgctgagccacaggctgctgtccaacttgcggttgcttaacgggcggcgaaggagaagtccacgcctacatgggggtagagtcataatcgtgcatcaggatagggcggtggtgctgcagcagcgcgcgaataaactgctgccgccgccgctccgtcctgcaggaatacaacatggcagtggtctcctcagcgatgattcgcaccgcccgcagcataaggcgccttgtcctccgggcacagcagcgcaccctgatctcacttaaatcagcacagtaactgcagcacagcaccacaatattgttcaaaatcccacagtgcaaggcgctgtatccaaagctcatggcggggaccacagaacccacgtggccatcataccacaagcgcaggtagattaagtggcgacccctcataaacacgctggacataaacattacctcttttggcatgttgtaattcaccacctcccggtaccatataaacctctgattaaacatggcgccatccaccaccatcctaaaccagctggccaaaacctgcccgccggctatacactgcagggaaccgggactggaacaatgacagtggagagcccaggactcgtaaccatggatcatcatgctcgtcatgatatcaatgttggcacaacacaggcacacgtgcatacacttcctcaggattacaagctcctcccgcgttagaaccatatcccagggaacaacccattcctgaatcagcgtaaatcccacactgcagggaagacctcgcacgtaactcacgttgtgcattgtcaaagtgttacattcgggcagcagcggatgatcctccagtatggtagcgcgggtttctgtctcaaaaggaggtagacgatccctactgtacggagtgcgccgagacaaccgagatcgtgttggtcgtagtgtcatgccaaatggaacgccggacgtagtcatatttcctgaagcaaaaccaggtgcgggcgtgacaaacagatctgcgtctccggtctcgccgcttagatcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgtttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaacggccctcacgtccaagtggacgtaaaggctaaacccttcagggtgaatctcctctataaacattccagcaccttcaaccatgcccaaataattctcatctcgccaccttctcaatatatctctaagcaaatcccgaatattaagtccggccattgtaaaaatctgctccagagcgccctccaccttcagcctcaagcagcgaatcatgattgcaaaaattcaggttcctcacagacctgtataagattcaaaagcggaacattaacaaaaataccgcgatcccgtaggtcccttcgcagggccagctgaacataatcgtgcaggtctgcacggaccagcgcggccacttccccgccaggaaccatgacaaaagaacccacactgattatgacacgcatactcggagctatgctaaccagcgtagccccgatgtaagcttgttgcatgggcggcgatataaaatgcaaggtgctgctcaaaaaatcaggcaaagcctcgcgcaaaaaagaaagcacatcgtagtcatgctcatgcagataaaggcaggtaagctccggaaccaccacagaaaaagacaccatttttctctcaaacatgtctgcgggtttctgcataaacacaaaataaaataacaaaaaaacatttaaacattagaagcctgtcttacaacaggaaaaacaacccttataagcataagacggactacggccatgccggcgtgaccgtaaaaaaactggtcaccgtgattaaaaagcaccaccgacagctcctcggtcatgtccggagtcataatgtaagactcggtaaacacatcaggttgattcacatcggtcagtgctaaaaagcgaccgaaatagcccgggggaatacatacccgcaggcgtagagacaacattacagcccccataggaggtataacaaaattaataggagagaaaaacacataaacacctgaaaaaccctcctgcctaggcaaaatagcaccctcccgctccagaacaacatacagcgcttccacagcggcagccataacagtcagccttaccagtaaaaaagaaaacctattaaaaaaacaccactcgacacggcaccagctcaatcagtcacagtgtaaaaaagggccaagtgcagagcgagtatatataggactaaaaaatgacgtaacggttaaagtccacaaaaaacacccagaaaaccgcacgcgaacctacgcccagaaacgaaagccaaaaaacccacaacttcctcaaatcgtcacttccgttttcccacgttacgtaacttcccattttaagaaaactacaattcccaacacatacaagttactccgccctaaaacctacgtcacccgccccgttcccacgccccgcgccacgtcacaaactccaccccctcattatcatattggcttcaatccaaaataaggtatattattgatgatg

SEQ ID NO: 138 - DNA, 34794 bp, Human adenovirus B2
catcatcaataatataccttatagatggaatggtgccaatatgtaaatgaggtgattttaaaaagtgtggatcgtgtggtgattggctgtggggttaacggctaaaaggggcggtgcgaccgtgggaaaatgacgttttgtgggggtggagtttttttgcaagttgtcgcgggaaatgtgacgcataaaaaggcttttttctcacggaactacttagttttcccacggtatttaacaggaaatgaggtagttttgaccggatgcaagtgaaaattgttgattttcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctagggtatttatacctcagggtttgtgtcaagaggccactcttgagtgccagcgagaagagttttctcctctgcgccggcagtttaataataaaaaaatgagagatttgcgatttctgcctcaggaaataatctctgctgagactggaaatgaaatattggagcttgtggtgcacgccctgatgggagacgatccggagccacctgtgcagctttttgagcctcctacgcttcaggaactgtatgatttagaggtagagggatcggaggattctaatgaggaagctgtaaatggcttttttaccgattctatgcttttagctgctaatgaagggttagaattagatccgcctttggacacttttgatactccaggggtaattgtggaaagcggtacaggtgtaagaaaattacctgatttgagttccgtggactgtgatttgcactgctatgaagacgggtttcctccgagtgatgaggaggaccatgaaaaggagcagtccatgcagactgcagcgggtgagggagtgaaggctgccaatgttggttttcagttggattgcccggagcttcctggacatggctgtaagtcttgtgaatttcacaggaaaaatactggagtaaaggaactgttatgttcgctttgttatatgagaacgcactgccactttatttacagtaagtgtgtttaagttaaaatttaaaggaatatgctgtttttcacatgtatattgagtgtgagttttgtgcttcttattataggtcctgtgtctgatgctgatgaatcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacgtccaagacaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagattctggttcgctagtgaattagctagggtagtttttaggataaaacaggactataaccaagaatttgaaaagttgttggtagattgcccaggactttttgaagctcttaatttgggccatcaggttcactttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggttcagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggggtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatatttcaaagatgtaacctgggcattctgaatgaaggcgaagcaagggtccgccactgcgcttctacagatactggatgttttattttgattaagggaaatgccagcgtaaagcataacatgatttgcggtgcttccgatgagaggccttatcaaatgctcacttgtgctggtgggcattgtaatatgctggctactgtgcatattgtttcccatcaacgcaaaaaatggcctgtttttgatcacaatgtgatgacgaagtgtaccatgcatgcaggtgggcgtagaggaatgtttatgccttaccagtgtaacatgaatcatgtgaaagtgttgttggaaccagatgccttttccagaatgagcctaacaggaatttttgacatgaacatgcaaatctggaagatcctgaggtatgatgatacgagatcgagggtacgcgcatgcgaatgcggaggcaagcatgccaggttccagccggtgtgtgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagctgccgccgccgcttctgttgccgctaacactgtgcttggaatgggttactatggaagcatcatggctaattccacttcctctaataacccttctaccctgactcaggacaagttacttgtccttttggcccagctggaggctttgacccaacgtctgggtgaactttctcagcaggtggtcgagttgcgagtacaaactgagtctgctgtcggcacggcaaagtctaaataaaaaaatcccagaatcaatgaataaataaacaagcttgttgttgatttaaaatcaagtgtttttatttcatttttcgcgcacggtatgccctagaccaccgatctctatcattgagaactcggtggattttttccaggatcctatagaggtgggattgaatgtttagatacatgggcattaggccgtctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggatgggtgcattcggggtgaaattatgtgcattttggattggatttttaagttggcaatattgccgccaagatcccgtcttgggttcatgttatgaaggaccaccaagacggtgtatccggtacatttaggaaatttatcgtgcagcttggatggaaaagcgtggaaaaatttggagacacccttgtgtcctccaagattttccatgcactcatccatgataatagcaatggggccgtgggcagcggcgcgggcaaacacgttccgtgggtctgacacatcatagttatgttcctgagttaaatcatcataagccattttaatgaatttggggcggagagtaccagattggggtatgaatgttccttcgggccccggagcatagttcccctcacagatttgcatttcccaagctttcagttccgagggtggaatcatgtccacctggggggctatgaaaaacaccgtttctggggcgggggtgattaattgtgatgatagcaaatttctgagcaattgagatttgccacatccggtggggccataaatgattccgattacgggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggtttcagaccgtcagccatgggcattttggagagagtttgctgcaaaagttctagtctgttccacagttcagtgatgtgttctatggcatctcgatccagcagacctcctcgtttcgcgggtttggacggctcctggaatagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcatcctgctggtcgaaaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacaacttgggcgcaaggaaaacggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtgtccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatttggtcagaaaacacaatttttttattgtcaagtttggtggcaaatgatccatacagggcgttggataaaagtttggcaatggatcgcatggtttggttcttttccttgtccgcgcgctctttggcggcgatgttgagttggacatactcgcgtgccaggcacttccattcggggaagatagttgttaattcatctggcacgattctcacttgccaccctcgattatgcaaggtaattaaatccacactggtggccacctcgcctcgaaggggttcattggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcgcgctcatatgggttaaggggactgccccatggcatgggatgggtgagtgcagaggcatacatgccacagatgtcatagacgtagatgggatcctcaaagatgcctatgtaggttggatagcatcgcccccctctgatacttgctcgcacatagtcatatagttcatgtgatggcgctagcagccccggacccaagttggtgcgattgggtttttctgttctgtagacgatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgtagcgaagcgtgagtaagggcaaaggtgtctctgaccatgactttgagaaattggtatttgaagtcgatgtcgtcacaggctccctgttcccagagttggaagtctacccgtttcttgtaggcggggttgggcaaagcgaaagtaacatcattgaagagaatcttaccggctctgggcataaaattgcgagtgatgcgaaaaggctgtggtacttccgctcgattgttgatcacctgggcagctaggacgatctcgtcgaaaccgttgatgttgtgtcctacgatgtataattctatgaaacgcggcgtgcctctgacgtgaggtagcttactgagctcatcaaaggttaggtctgtggggtcagataaggcgtagtgttcgagagcccattcgtgcaggtgaggatttgcatgtaggaatgatgaccaaagatctaccgccagtgctgtttgtaactggtcccgatactgacgaaaatgccggccaattgccattttttctggagtgacacagtagaaggttctggggtcttgttgccatcgatcccacttgagtttaatggctagatcgtgggccatgttgacgagacgctcttctcctgagagtttcatgaccagcatgaaaggaactagttgtttgccaaaggatcccatccaggtgtaagtttccacatcgtaggtcaggaagagtctttctgtgcgaggatgagagccgatcgggaagaactggatttcctgccaccagttggaggattggctgttgatgtgatggaagtagaagtttctgcggcgcgccgagcattcgtgtttgtgcttgtacagacggccgcagtagtcgcagcgttgcacgggttgtatctcgtgaatgagttgtacctggcttcccttgacgagaaatttcagtgggaagccgaggcctggcgattgtatctcgtgctcttctatattcgctgtatcggcctgttcatcttctgtttcgatggtggtcatgctgacgagcccccgcgggaggcaagtccagacctcggcgcgggaggggcggagctgaaggacgagagcgcgcaggctggagctgtccagagtcctgagacgctgcggactcaggttagtaggtagggacagaagattaacttgcatgatcttttccagggcgtgcgggaggttcagatggtacttgatttccacaggttcgtttgtagagacgtcaatggcttgcagggttccgtgtcctttgggcgccactaccgtacctttgttttttcttttgatcggtggtggctctcttgcttcttgcatgctcagaagcggtgacggggacgcgcgccgggcggcagcggttgttccggacccgagggcatggctggtagtggcacgtcggcgccgcgcacgggcaggttctggtactgcgctctgagaagacttgcgtgcgccaccacgcgtcgattgacgtcttgtatctgacgtctctgggtgaaagctaccggccccgtgagcttgaacctgaaagagagttcaacagaatcaatttcggtatcgttaacggcagcttgtctcagtatttcttgtacgtcaccagagttgtcctggtaggcgatctccgccatgaactgctcgatttcttcctcctgaagatctccgcgacccgctctttcgacggtggccgcgaggtcattggagatacggcccatgagttgggagaatgcattcatgcccgcctcgttccagacgcggctgtaaaccacggccccctcggagtctcttgcgcgcatcaccacctgagcgaggttaagctccacgtgtctggtgaagaccgcatagttgcataggcgctgaaaaaggtagttgagtgtggtggcaatgtgttcggcgacgaagaaatacatgatccatcgtctcagcggcatttcgctaacatcgcccagagcttccaagcgctccatggcctcgtagaagtccacggcaaaattaaaaaactgggagtttcgcgcggacacggtcaattcctcctcgagaagacggatgagttcggctatggtggcccgtacttcgcgttcgaaggctcccgggatctcttcttcctcttctatctcttcttccactaacatctcttcttcgtcttcaggcgggggcggagggggcacgcggcgacgtcgacggcgcacgggcaaacggtcgatgaatcgttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcacgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaatccgcgcattggttgtaccagtgccaagtcagctacgactctttcggcgaggatggcttgctgtacttgggtaagggtggcttgaaagtcatcaaaatccacaaagcggtggtaagctcctgtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaccctataagaaaatgcggcggtggttggcggtagagaggccatcgttctgtagctggagcgccaggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagatgcatcccgtgctgcgacagatgcgcccccaacaacagcccccctcgcagcagcagcagcagcaatcacaaaaggctgtccctgcaactactgcaactgccgccgtgagcggtgcgggacagcccgcctatgatctggacttggaagagggcgaaggactggcacgtctaggtgcgccttcacccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggaccgaagacgagtgttgcgggacgaggatttcgaagttgatgaaatgacagggatcagtcctgccagggcacacgtggctgcagccaaccttgtatcggcttacgagcagacagtaaaggaagagcgtaacttccaaaagtcttttaataatcatgtgcgaaccctgattgcccgcgaagaagttacccttggtttgatgcatttgtgggatttgatggaagctatcattcagaaccctactagcaaacctctgaccgcccagctgtttctggtggtgcaacacagcagagacaatgaggctttcagagaggcgctgctgaacatcaccgaacccgaggggagatggttgtatgatcttatcaacattctacagagtatcatagtgcaggagcggagcctgggcctggccgagaaggtggctgccatcaattactcggttttgagcttgggaaaatattacgctcgcaaaatctacaagactccatacgttcccatagacaaggaggtgaagatagatgggttctacatgcgcatgacgctcaaggtcttgaccctgagcgatgatcttggggtgtatcgcaatgacagaatgcatcgcgcggttagcgccagcaggaggcgcgagttaagcgacagggaactgatgcacagtttgcaaagagctctgactggagctggaaccgagggtgagaattacttcgacatgggagctgacttgcagtggcagcctagtcgcagggctctgagcgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgtgatgccaacctgggttcgctggtggcgttaaatgctttcttgagtactcagcctgctaatgtgccgcgtggtcaacaggattatactaactttttaagcgctttgagactgatggtatcagaagtacctcagagcgaagtgtatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcatgggtgctaccgcggctgagcccgagtctgcaagtccttttcctagtctacccttttctctacacagtgtacgtagcagcgaagtgggtagaataagtcgcccgagtttaatgggcgaagaggagtatctaaacgattccttgctcagaccggcaagagaaaaaaatttcccaaacaatggaatagaaagtttggtggataaaatgagtagatggaagacttatgctcaggatcacagagacgagcctgggatcatggggattacaagtagagcgagccgtagacgccagcgccatgacagacagaggggtcttgtgtgggacgatgaggattcggccgatgatagcagcgtgctggacttgggtgggagaggaaggggcaacccgtttgctcatttgcgccctcgcttgggtggtatgttgtaaaaaaaaataaaaaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttattcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaagaccatcatgcatactaacatgccaaacgtgaacgagtatatgtttagtaacaagttcaaagcgcgtgtgatggtgtccagaaaacctcccgacggtgctgcagttggggatacttatgatcacaagcaggatattttgaaatatgagtggttcgagtttactttgccagaaggcaacttttcagttactatgactattgatttgatgaacaatgccatcatagataattacttgaaagtgggtagacagaatggagtgcttgaaagtgacattggtgttaagttcgacaccaggaacttcaagctgggatgggatcccgaaaccaagttgatcatgcctggagtgtatacgtatgaagccttccatcctgacattgtcttactgcctggctgcggagtggattttaccgagagtcgtttgagcaaccttcttggtatcagaaaaaaacagccatttcaagagggttttaagattttgtatgaagatttagaaggtggtaatattccggccctcttggatgtagatgcctatgagaacagtaagaaagaacaaaaagccaaaatagaagctgctacagctgctgcagaagctaaggcaaacatagttgccagcgactctacaagggttgctaacgctggagaggtcagaggagacaattttgcgccaacacctgttccgactgcagaatcattattggccgatgtgtctgaaggaacggacgtgaaactcactattcaacctgtagaaaaagatagtaagaatagaagctataatgtgttggaagacaaaatcaacacagcctatcgcagttggtatctttcgtacaattatggcgatcccgaaaaaggagtgcgttcctggacattgctcaccacctcagatgtcacctgcggagcagagcaggtctactggtcgcttccagacatgatgaaggatcctgtcactttccgctccactagacaagtcagtaactaccctgtggtgggtgcagagcttatgcccgtcttctcaaagagcttctacaacgaacaagctgtgtactcccagcagctccgccagtccacctcgcttacgcacgtcttcaaccgctttcctgagaaccagattttaatccgtccgccggcgcccaccattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctacccaacatcctgtccgtgttcgcggacattttcgcgctccatggggcgccctcaagggccgcactcgcgttcgaaccaccgtcgatgatgtaatcgatcaggtggttgccgacgcccgtaattatactcctactgcgcctacatctactgtggatgcagttattgacagtgtagtggctgacgctcgcaactatgctcgacgtaagagccggcgaaggcgcattgccagacgccaccgagctaccactgccatgcgagccgcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggttaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcggctgaccgattaggcgagtttgcttatggcaagcgtagtagaataacttccaaggatgagacagtgtcgatacccttggatcatggaaatcccacccctagtcttaaaccggtcactttgcagcaagtgttacccgtaactccgcgaacaggtgttaaacgcgaaggtgaagatttgtatcccactatgcaactgatggtacccaaacgccagaagttggaggacgttttggagaaagtaaaagtggatccagatattcaacctgaggttaaagtgagacccattaagcaggtagcgcctggtctgggggtacaaactgtagacattaagattcccactgaaagtatggaagtgcaaactgaacccgcaaagcctactgccacctccactgaagtgcaaacggatccatggatgcccatgcctattacaactgacgccgccggtcccactcgaagatcccgacgaaagtacggtccagcaagtctgttgatgcccaattatgttgtacacccatctattattcctactcctggttaccgaggcactcgctactatcgcagccgaaacagtacctcccgccgtcgccgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatatggccctcacttgtcgccttcgcgttcccatcactggttaccgaggaagaaactcgcgccgtagaagagggatgttgggacgcggaatgcgacgctacaggcgacggcgtgctatccgcaagcaattgcggggtggttttttaccagccttaattccaattatcgctgctgcaattggcgcgataccaggcatagcttccgtggcggttcaggcctcgcaacgacattgacattggaaaaaaacgtataaataaaaaaaaaaaaatacaatggactctgacactcctggtcctgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggcatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagccccaatggccaccggggtgatgaaaccttctcagttgcatcgacccgtcaccttggatttgccccctccccctgctgctactgctgtacccgcttctaagcctgtcgctgccccgaaaccagtcgccgtagccaggtcacgtcccgggggcgctcctcgtccaaatgcgcactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcccaccgtagcgccgacccacgatgtgaccaccgaccgtagccagcggctcatgttgcgcttcgtgcccgttgaccgggaggacaatacatactcttacaaagtgcggtacaccctggccgtgggcgacaacagagtgctggatatggccagcacgttctttgacattaggggtgtgttggacagaggtcccagtttcaaaccctattctggtacggcttacaactccctggctcctaaaggcgctccaaatacatctcagtggattgcagaaggtgtaaaaaatacaactggtgaggaacacgtaacagaagaggaaaccaatactactacttacacttttggcaatgctcctgtaaaagctgaagctgaaattacaaaagaaggactcccagtaggtttggaagtttcagatgaagaaagtaaaccgatttatgctgataaaacatatcagccagaacctcagctgggagatgaaacttggactgaccttgatggaaaaaccgaaaagtatggaggcagggctctcaaacccgatactaagatgaaaccatgctacgggtcctttgccaaacctactaatgtgaaaggcggtcaggcaaaacaaaaaacaacggagcagccaaatcagaaagtcgaatatgatatcgacatggagttttttgatgcggcatcgcagaaaacaaacttaagtcctaaaattgtcatgtatgcagaaaatgtaaatttggaaactccagacactcatgtagtgtacaaacctggaacagaagacacaagttccgaagctaatttgggacaacaatctatgcccaacagacccaactacattggcttcagagataactttattggacttatgtactataacagtactggtaacatgggggtgctggctggtcaagcgtctcagttaaatgcagtggttgacttgcaggacagaaacacagaactttcttaccaactcttgcttgactctctgggcgacagaaccagatactttagcatgtggaatcaggctgtggacagttatgatcctgatgtacgtgttattgaaaatcatggtgtggaagatgaacttcccaactactgttttccactggacggcataggtgttccaacaaccagttacaaatcaatagttccaaatggagacaatgcgcctaattggaaggaacctgaagtaaatggaacaagtgagatcggacagggtaatttgtttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtgaacatggttctacagagttccctcggtaacgacctgcgggtagatggcgccagcatcagtttcacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctactttgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgccaaggtcaaccctatcccgctaactatccctatccactcattggaacaactgccgtaaatagtgttacgcagaaaaagttcttgtgtgacagaaccatgtggcgcataccgttctcgagcaacttcatgtctatgggggcccttacagacttgggacagaatatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaaccatggcctgcggatcccaaaacggctccagcgagcaagagctcagagccattgtccaagacctgggttgcggaccctattttttgggaacctacgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccgctgtattacgctggaaaaatctacccagaccgtgcagggtccccgttctgccgcctgcggacttttctgctgcatgttccttcacgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttcttaatacccattcgccttattttcgctcccatcgtacacacatcgaaagggccactgcgttcgaccgtatggatgttcaataatgactcatgtaaacaacgtgttcaataaacatcactttatttttttacatgtatcaaggctctgcattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctccaagcaggtcaggagccgaaatcttgaaatcacaattaggaccagtgctttgagcgcgagagttgcggtacaccggattgcagcactgaaacaccatcagcgacggatgtctcacgcttgccagcacggtgggatctgcaatcatgcccacatccagatcttcagcattggcaatgctgaacggggtcatcttgcaggtctgcctacccatggcgggcacccaattaggcttgtggttgcaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcacagccggcatcattcacacagcagcgggcgtcattgttagctatttgcaccacacttctgccccagcggttttgggtgattttggttcgctcgggattctcctttaaggctcgttgtccgttctcgctggccacatccatctcgataatctgctccttctgaatcataatattgccatgcaggcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgtttacgtactggtgacagatgcgcttgtattgttcgtgttgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttagcgatcttctcaatgcttcttttgccatccttctcaacgatgcgcacgggcgggtagctgaaacccactgctacaagttgcgcctcttctctttcttcttcgctgtcttgactgatgtcttgcatggggatatgtttggtcttccttggcttctttttggggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagacagacatcgagcaagacccgggctatgtgacaccggtggaacacgaggaagagttgaaacgctttctagagagagaggatgaaaactgcccaaaacaacgagcagataactatcaccaagatgctggaaatagggatcagaacaccgactacctcatagggcttgacggggaagacgcgctccttaaacatctagcaagacagtcgctcatagtcaaggatgcattattggacagaactgaagtgcccatcagtgtggaagagctcagccgcgcctacgagcttaacctcttttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcatcgaggtcacacacttcgcatatcccgctgtcaacctgccccctaaagtcatgacggcggtcatggaccagttactcattaagcgcgcaagtcccctttcagaagacatgcatgacccagatgcctgtgatgagggtaaaccagtggtcagtgatgagcagctaacccgatggctgggcaccgactctcccagggatttggaagagcgtcgcaagcttatgatggccgtggtgctggttaccgtagaactagagtgtctccgacgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcaccctgaagggggaagcccgccgtgattacatccgcgattgtgtctatctgtacctgtgccacacgtggcaaaccggcatgggtgtatggcagcaatgtttagaagaacagaacttgaaagagcttgacaagctcttacagaaatctcttaaggttctgtggacagggttcgacgagcgcaccgtcgcttccgacctggcagacctcatcttcccagagcgtctcagggttactttgcgaaacggattgcctgactttatgagccagagcatgcttaacaattttcgctctttcatcctggaacgctccggtatcctgcccgccacctgctgcgcactgccctccgactttgtgcctctcacctaccgcgagtgccccccgccgctatggagtcactgctacctgttccgtctggccaactatctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgctccggaagattaccacccctatgaaatcaagttctatgaggaccaatcacagcctccaaaggccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaaacaagaagttgaaggtgcagccgccgcccccagaagatatggaggaagattgggacagtcaggcagaggaggcggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggtcaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcaaccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagctggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcattacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcttagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcttattaagtgcggatgggaatgcaggtccgttgaaattacacacaataacaaaacctggaacaataccttatccaccacatgggagccaggagttcccgagtggtacactgtctctgtccgaggtcctgacggttccatccgcattagtaacaacactttcattttttctgaaatgtgcgatctggccatgttcatgagcaaacagtattctctatggcctcctagcaaggacaacatcgtaacgttctccattgcttattgcttgtgcgcttgccttcttactgctttactgtgcgtatgcatacacctgcttgtaaccactcgcatcaaaaacgccaataacaaagaaaaaatgccttaacctctttctgtttacagacatggcttctcttacatctctcatatttgtcagcattgtcactgccgctcatggacaaacagtcgtctctatccctctaggacataattacactctcataggacccccaatcacttcagaggtcatctggaccaaactgggaagcgttgattactttgatataatctgcaacaaaacaaaaccaataatagtaacttgcaacatacaaaatcttacattgattaatgttagcaaagtttacagcggttactattatggttatgacagatacagtagtcaatatagaaattacttggttcgtgttacccagttgaaaaccacgaaaatgccaaatatggcaaagattcgatccgatgacaattctctagaaacttttacatctcccaccacacccgacgaaaaaaacatcccagattcaatgattgcaattgttgcagcggtggcagtggtgatggcactaataataatatgcatgcttttatatgcttgtcgctacaaaaagtttcatcctaaaaaacaagatctcctactaaggcttaacatttaatttctttttatacagccatggtttccactaccacattccttatgcttactagtctcgcaactctgacttctgctcgctcacacctcactgtaactataggctcaaactgcacactaaaaggacctcaaggtggtcatgtcttttggtggagaatatatgacaatggatggtttacaaaaccatgtgaccaacctggtagatttttctgcaacggcagagacctaaccattatcaacgtgacagcaaatgacaaaggcttctattatggaaccgactataaaagtagtttagattataacattattgtactgccatctaccactccagcaccccgcacaactactttctctagcagcagtgtcgctaacaatacaatttccaatccaacctttgccgcgcttttaaaacgcactgtgaataattctacaacttcacatacaacaatttccacttcaacaatcagcattatcgctgcagtgacaattggaatatctattcttgtttttaccataacctactacgcctgctgctatagaaaagacaaacataaaggtgatccattacttagatttgatatttaatttgttctttttttttttatttacagtatggtgaacaccaatcatggtacctagaaatttcttcttcaccatactcatttgtgcatttaatgtttgcgctactttcacagcagtagccacagcaaccccagactgtataggagcatttgcttcctatgcactttttgcttttgttacttgcatctgcgtatgtagcatagtctgcctggttattaattttttccaacttatagactggatccttgtgcgaattgcctacctgcgccaccatcccgaataccgcaaccaaaatatcgcggcacttcttagactcatctaaaaccatgcaggctatactaccaatatttttgcttctattgcttccctacgctgtctcaaccccagctgcctatagtactccaccagaacaccttagaaaatgcaaattccaacaaccgtggtcatttcttgcttgctatcgagaaaaatcagaaattcccccaaatttaataatgattgctggaataattaatataatctgttgcaccataatttcatttttgatataccccctatttgattttggctggaatgctcccaatgcacatgatcatccacaagacccagaggaacacattcccctacaaaacatgcaacatccaatagcgctaatagattacgaaagtgaaccacaacccccactactccctgctattagttacttcaacctaaccggcggagatgactgaaacactcaccacctccaattccgccgaggatctgctcgatatggacggccgcgtctcagaacagcgactcgcccaactacgcatccgccagcagcaggaacgcgcggccaaagagctcagagatgtcatccaaattcaccaatgcaaaaaaggcatattctgtttggtaaaacaagccaagatatcctacgagatcaccgctactgaccatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatacggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccaaacggagttcttactttaaaatgtttaaccccactaacaaccacaggcggatctctacagctaaaagtgggagggggacttacagtggatgacaccaacggttttttgaaagaaaacataagtgccaccacaccactcgttaagactggtcactctataggtttaccactaggagccggattgggaacgaatgaaaataaactttgtatcaaattaggacaaggacttacattcaattcaaacaacatttgcattgatgacaatattaacaccttatggacaggagtcaaccccaccgaagccaactgtcaaatcatgaactccagtgaatctaatgattgcaaattaattctaacactagttaaaactggagcactagtcactgcatttgtttatgttataggagtatctaacaattttaatatgctaactacacacagaaatataaattttactgcagagctgtttttcgattctactggtaatttactaactagactctcatccctcaaaactccacttaatcataaatcaggacaaaacatggctactggtgccattactaatgctaaaggtttcatgcccagcacgactgcctatcctttcaatgataattctagagaaaaagaaaactacatttacggaacttgttactacacagctagtgatcgcactgcttttcccattgacatatctgtcatgcttaaccgaagagcaataaatgacgagacatcatattgtattcgtataacttggtcctggaacacaggagatgccccagaggtgcaaacctctgctacaaccctagtcacctccccatttaccttttactacatcagagaagacgactgacaaataaagtttaacttgtttatttgaaaatcaattcacaaaatccgagtagttattttgcctcccccttcccatttaacagaatacaccaatctctccccacgcacagctttaaacatttggataccattagatatagacatggttttagattccacattccaaacagtttcagagcgagccaatctggggtcagtgatagataaaaatccatcgggatagtcttttaaagcgctttcacagtccaactgctgcggatgcgactccggagtctggatcacggtcatctggaagaagaacgatgggaatcataatccgaaaacggtatcggacgattgtgtctcatcaaacccacaagcagccgctgtctgcgtcgctccgtgcgactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacaaccacactcttaagttggtcaaaagaatgctggcttcagttgtaatcaaaactccatcgcatctaatcgttctgaggaaatcatccacggtagcatatgcaaatcccaaccaagcaatgcaactggattgtgtttcaagcaggagaggagagggaagagacggaagaaccatgttaatttttattccaaacgatctcgcagtacttcaaattgtagatcgcgcagatggcatctctcgcccccactgtgttggtgaaaaagcacagctagatcaaaagaaatgcgattttcaaggtgctcaacggtggcttccagcaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataataaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacagatggataaatcagtctttccatcacaagacaagccacagggtctccagctcgaccctcgtaaaacctgtcatcatgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacacaaagcacaagctctaaagtgactctccaacctctccacaatatatatatacacaagccctaaactgacgtaatgggagtaaagtgtaaaaaatcccgccaaacccaacacacaccccgaaactgcgtcaccagggaaaagtacagtttcacttccgcaatcccaacaggcgtaacttcctctttctcacggtacgtgatatcccactaacttgcaacgtcattttcccacggtcgcaccgccccttttagccgttaaccccacagccaatcaccacacgatccacactttttaaaatcacctcatttacatattggcaccattccatctataaggtatattattgatgatg

SEQ ID NO: 139 - DNA, 35343 bp, Human adenovirus type 3
ctatctatataatataccttatagatggaatggtgccaacatgtaaatgaggtaatttaaaaaagtgcgcgctgtgtggtgattggctgcggggttaacggctaaaaggggcggcgcgaccgtgggaaaatgacgtgacttatgtgggaggagttatgttgcaagttattacggtaaatgtgacgtaaaacgaggtgtggtttgaacacggaagtagacagttttcccacgcttactgacaggatatgaggtagttttgggcggatgcaagtgaaaattctccattttcgcgcgaaaactaaatgaggaagtgaatttctgagtcatttcgcggttatgccagggtggagtatttgccgagggccgagtagactttgaccgtttacgtggaggtttcgattaccgtgtttttcacctaaatttccgcgtacggtgtcaaagttctgtgtttttacgtaggtgtcagctgatcgctagggtatttaaacctgacgagttccgtcaagaggccactcttgagtgccagcgagaagagttttctcctccgcgccgcaagtcagttctgcgctttgaaaatgagacacctgcgcttcctgccacaggaggttatctccagtgagaccgggatcgaaatactggagtttgtggtaaataccctaatgggagacgacccggaaccgccagtgcagcctttcgatccacctacgctgcacgatctgtatgatttagagatagacgggccggaggatcccaatgaggaagctgtgaatgggttttttactgattctatgctgctagctgctgatgaaggattggacataaaccctcctcctgagacacttgttaccccaggggtggttgtggaaagcggcataggtgggaaaaaattgcctgatctgggagcagctgaaatggacttgcgttgttatgaagagggttttcctcccagtgatgatgaagatggggaaactgagcagtccatccataccgcagtaaatgagggagtaaaagctgccagcgatgtttttaagttggactgtccggagctgcctggacatggctgtaagtcttgtgaatttcacaggaataacactggaatgaaagaactattgtgctcgctttgctatatgagaatgcactgccactttatttacagtaagtgtatttaagtgaaatttaaaggaatagtgtagctatttaataactgttgaatggtagatttatgtttttttcttgcgattttttgtaggtcctgtgtctgatgatgagtcaccttctcctgattcaactacctcacctcctgaaattcaggcgcccgcacctgcaaacgtatgcaagcccattcctgtgaagcctaagcctgggaaacgccctgctgtggataagcttgaggacttgttggagggtggggatggacctttggaccttagtacccggaaactgccaaggcaatgagtgccctgcagctgtgtttatttaatgtgacgtcatgtaataaaattatgtcagctgctgagtgttttattacttcttgggtggggacttggatatataagtaggagcagatctgtgtggttagctcacagcaacctgctgccatccatggaggtttgggctatcttggaagacctcagacagactaagctactgctagaaaacgcctcggacggagtctctggcctttggagattctggttcggtggtgatctagctaggctagtgtttaggataaaacaggactacagggaagaatttgaaaagttattggacgatagtccgggactttttgaagctcttaacttgggtcatcaggctcattttaaggagaaggttttatcagttttagatttttctactcctggtagaactgctgctgctgtagcttttcttacttttatattggataaatggatccgccaaactcacttcagcaagggatacgttttggatttcatagcagcagctttgtggagaacatggaaggctcgcaggatgaggacaatcttagattactggccagtgcagcctctgggagtagcagggatactgagacacccaccgaccatgccagcggttctgcaggaggagcagcaggaggacaatccgagagccggcctggaccctccggtggaggagtagctgacctgtttcctgaactgcgacgggtgcttactaggtctacgaccagtggacagaacaggggaattaagagggagaggaatcctagtgggaataattcaagaaccgagttggctttaagtttaatgagccgcaggcgtcctgaaactgtttggtggcatgaggttcagagcgaaggcagggatgaagtttcaatattgcaggagaaatattcactagaacaacttaagacctgttggttggaacctgaggatgattgggaggtggccattaggaattatgctaagatatctctgaggcctgataaacaatatagaattactaagaagattaatattagaaatgcatgctacatatcagggaatggggcagaggttataatagatacacaagataaagcagtttttagatgttgtatgatgggtatgtggccaggggttgtcggcatggaagcagtaacacttatgaatattaggtttaaaggggatgggtataatggcattgtatttatggctaacactaagctgattctacatggttgtagcttttttgggtttaataatacgtgtgtagaagcttgggggcaagttagtgtgaggggttgtagtttttatgcatgctggattgcaacatcaggtagggtcaagagtcagttgtctgtgaagaaatgcatgtttgagagatgtaatcttggcatactgaatgaaggtgaagcaagggtccgccactgcgcagctacagaaactggctgcttcattctaataaagggaaatgccagtgtgaagcataatatgatctgtggacattcggatgagaggccttatcagatgctgacctgcgctggtggacattgcaatattcttgctaccgtgcatatcgtttcacatgcacgcaaaaaatggcctgtatttgaacataatgtgattaccaagtgcaccatgcacataggtggtcgcaggggaatgtttatgccttaccagtgtaacatgaatcatgtgaaggtaatgttggaaccagatgccttttccagagtgagcttaacaggaatctttgatatgaatattcaactatggaagatcctgagatatgatgacactaaaccaagggtgcgcgcatgcgaatgcggaggcaagcatgctagattccagccggtgtgcgtggatgtgactgaagacttgagacccgatcatttggtgcttgcctgcactggagcggagttcggttctagtggtgaagaaactgactaaagtgagtagtggggcaagatgtggatggggactttcaggttggtaaggtgggcagattgggtaaattttgttaatttctgtcttgcagctgccatgagtggaagcgcttcttttgaggggggagtatttagcccttatctgacgggcaggctcccaccatgggcaggagttcgtcagaatgtcatgggatccactgtggatgggagacccgtccagcccgccaattcctcaacgctgacctatgccactttgagttcgtcaccattggatgcagctgcagccgccgccgctactgctgccgccaacaccatccttggaatgggctattatggaagcatcgttgccaattccagttcctctaataacccttcaaccctggctgaggacaagctacttgttctcttggcgcagctcgaggccttaacccaacgcttaggcgaactgtctaagcaggtggcccagttgcgtgagcaaactgagtctgctgttgccacagcaaagtctaaataaagatctcaaatcaataaataaagaaatacttgatataaaacaaatgaatgtttatttgatttttcgcgcgcggtatgccctggaccatcggtctcgatcattgagaacgcggtggatcttttccagtaccctgtaaaggtgggattgaatgtttagatacatgggcattagtccgtctcgggggtggagatagctccattgaagagcctcttgctccggggtagtgttataaatcacccagtcatagcaaggtcggagtgcatggtgttgcacaatatcttttaggagcagactaattgcaacggggaggcccttagtgtaggtgtttacaaatctgttgagctgggacgggtgcatccggggtgaaattatatgcattttggactggatcttgaggttggcaatgttgccgcctagatcccgtctcgggttcatattgtgcaggaccaccaagacagtgtatccggtgcacttgggaaatttatcatgcagcttagagggaaaagcatgaaaaaatttggagacgcctttgtgaccccccagattctccatgcactcatccataatgatagcgatggggccgtgggcagcggcacgggcgaacacgttccgggggtctgaaacatcatagttatgctcctgagtcaggtcatcataagccattttaataaactttgggcggagggtgccagattgggggatgaaagttccctctggcccgggagcatagtttccctcacatatttgcatttcccaggctttcagttcagagggggggatcatgtccacctgcggggctataaaaaataccgtttctggagccggggtgattaactgggacgagagcaaattcctaagcagctgagacttgccgcacccagtgggaccgtaaatgaccccaattacgggttgcagatggtagtttagggaacgacagctgccgtcctcccggagcaggggggccacttcgttcatcatttcccttacatggatattttcccgcaccaagtccgttaggaggcgctctcccccaagggatagaagctcctggagcgaggagaagtttttcagcggcttcagcccgtcagccatgggcattttggaaagagtctgttgcaagagctcgagccggtcccagagctcggtgatgtgctctatggcatctcgatccagcagacctcctcgtttcgcgggttgggacggctcctggagtagggaatcagacgatgggcgtccagcgctgccagggtccgatccttccatggtcgcagcgtccgagtcagggttgtttccgtcacggtgaaggggtgcgcgcctggttgggcgcttgcgagggtgcgcttcagactcatcctgctggtcgagaaccgctgccgattggcgccctgcatgtcggccaggtagcagtttaccatgagttcgtagttgagcgcctcggccgcgtggcctttggcacggagcttacctttggaagttttatggcaggcggggcagtagatacatttgagggcatacaacttgggcgcgaggaaaatggattcgggggagtatgcatccgcaccgcaggaggcgcagacggtttcgcactccacgagccaggtcagatccggctcatcggggtcaaaaacaagttttccgccatgttttttgatgcgtttcttacctttggtttccatgagttcgtgtccccgctgggtgacaaagaggctgtccgtgtccccgtagaccgactttatgggcctgtcctcgagcggagtgcctcggtcctcttcgtagaggaacccagcccactctgatacaaaagcgcgtgtccaggccagcacaaaggaggccacgtgggaggggtagcggtcgttgtcaaccagggggtccaccttctctacggtatgtaaacacatgtccccctcctccacatccaagaatgtgattggcttgtaagtgtaggccacgtgaccaggggtccccgccgggggggtataaaagggggcgggcctctgttcgtcctcactgtcttccggatcgctgtccaggagcgccagctgttggggtaggtattccctctcgaaggcgggcatgacctctgcactcaggttgtcagtttctaggaacgaggaggatttgatattgacagtaccagcagagatgcctttcataagactctcgtccatctggtcagaaaacacaatcttcttgttgtccagcttggtggcaaatgatccatagagggcattggatagaagcttggcgatggagcgcatggtttggttcttttccttgtccgcgcgctccttggcggtgatgttaagctggacgtactcgcgcgccacacatttccattcaggaaagatggttgtcagttcatccggaactattctgattcgccatcccctattgtgcagggttatcagatccacactggtggccacctcgcctcggaggggctcattggtccagcagagtcgacctccttttcttgaacagaaaggggggagggggtctagcatgaactcatcaggggggtccgcatctatggtaaatattcccggtagcaaatctttgtcaaaatagctgatggtggcgggatcatccaaggtcatctgccattctcgaactgccagcgcgcgctcataggggttaagaggggtgccccagggcatggggtgggtgagcgcggaggcatacatgccacagatatcgtagacatagaggggctcttcgaggatgccgatgtaagtgggataacatcgcccccctctgatgcttgctcgcacatagtcatagagttcatgtgagggggcaagaagacccgggcccagattggtgcggttgggtttttccgccctgtaaacgatctggcgaaagatggcatgggaattggaagagatagtaggtctctggaatatgttaaaatgggcatgaggtaagcctacagagtcccttatgaagtgggcatatgactcttgcagcttggctaccagctcggcggtgatgagtacatccagggcacagtagtcgagagtttcctggatgatgtcataacgcggttggcttttcttttcccacagctcgcggttgagaaggtattcttcgtgatccttccagtactcttcgaggggaaacccgtctttttctgcacggtaagagcccaacatgtagaactgattgactgccttgtagggacagcatcccttctccactgggagagagtatgcttgggctgcattgcgcagcgaggtatgagtgagggcaaaagtgtccctgaccatgactttgaggaattgatacttgaagtcgatgtcatcacaggccccctgttcccagagttggaagtccacccgcttcttgtaggcggggttgggcaaagcgaaagtaacatcattgaagaggatcttgccggccctgggcatgaaatttcgggtgattttgaaaggctgaggaacctctgctcggttattgataacctgagcggccaagacgatctcatcaaagccattgatgttgtgccccactatgtacagttctaagaatcgaggggtgcccctgacatgaggcagcttcttgagttcttcaaaagtgagatctgtagggtcagtgagagcatagtgttcgagggcccattcgtgcacgtgagggttcgctttaaggaaggaggaccagaggtccactgccagtgctgtttgtaactggtcccggtactgacgaaaatgctgtccgactgccatcttttctggggtgacgcaatagaaggtttgggggtcctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggatgagagccaatcgggaagaactggatctcctgccaccagttggaggaatggctgttgatgtgatggaagtagaactccctgcgacgcgccgagcattcatgcttgtgcttgtacagacggccgcagtactcgcagcgattcacgggatgcaccttatgaatgagttgtacctgacttcctttgacgagaaatttcagtggaaaattgaggcctggcgcttgtacctcgcgctttactatgttgtctgcatcggcatgaccatcttctgtctcgatggtggtcatgctgacgagccctcgcgggaggcaagtccagacctcggcgcggcaggggcggagctcgaggacgagagcgcgcaggccggagctgtccagggtcctgagacgctgcggagtcaggttagtaggcagtgtcaggagattaacttgcatgatcttttggagggcgtgagggaggttcagatagtacttgatctcaacgggtccgttggtggagatgtcgatggcttgcagggttccgtgtcccttgggcgctaccaccgtgcccttgtttttcattttggacggcggtggctctgttgcttcttgcatgtttagaagcggtgtcgagggcgcgcaccgggcggcaggggcggctcgggacccggcggcatggctggcagtggtacgtcggcgccgcgcgcgggtaggttctggtactgcgccctgagaagactcgcatgcgcgacgacgcggcggttgacatcctggatctgacgcctctgggtgaaagctaccggccccgtgagcttgaacctgaaagagagttcaacagaatcaatctcggtatcgttgacggcggcttgcctaaggatttcttgcacgtcgccagagttgtcctggtaggcgatctcggccatgaactgctcgatctcttcctcttgaagatctccgcggcccgctctctcgacggtggccgcgaggtcgttggagatgcgcccaatgagttgagagaatgcattcatgcccgcctcgttccagacgcggctgtagaccacagcccccacgggatctctcgcgcgcatgaccacctgggcgaggttgagctccacgtggcgggtgaagaccgcatagttgcataggcgctggaaaaggtagttgagtgtggtggcgatgtgctcggtgacgaagaaatacatgatccatcgtctcagcggcatctcgctgacatcgcccagcgcttccaagcgctccatggcctcgtagaagtccacggcaaagttaaaaaactgggagttacgcgcggacacggtcaactcctcttccagaagacggataagttcggcgatggtggtgcgcacctcgcgctcgaaagcccctgggatttcttcctcaatctcttcttcttccactaacatctcttcctcttcaggtggggctgcaggaggagggggaacgcggcgacgccggcggcgcacgggcagacggtcgatgaatctttcaatgacctctccgcggcggcggcgcatggtctcggtgacggcacgaccgttctccctgggtctcagagtgaagacgcctccgcgcatctccctgaagtggtgactgggaggctctccgttgggcagggacaccgcgctgattatgcattttatcaattgccccgtaggtactccgcgcaaggacctgatcgtctcaagatccacgggatctgaaaacctttcgacgaaagcgtctaaccagtcgcaatcgcaaggtaggctgagcactgtttcttgcgggcgggggcggctagacgctcggtcggggttctctctttcttctccttcctcctcttgggagggtgagacgatgctgctggtgatgaaattaaaataggcagttttgagacggcggatggtggcgaggagcaccaggtctttgggtccggcttgttggatacgcaggcgatgagccattccccaagcattatcctgacatctggccagatctttatagtagtcttgcatgagtcgttccacgggcacttcttcttcgcccgctctgccatgcatgcgagtgatcccgaacccgcgcatgggctggacaagtgccaggtccgctacaaccctttcggcgaggatggcttgctgcacctgggtgagggtggcttggaagtcgtcaaagtccacgaagcggtggtaggccccggtgttgattgtgtaggagcagttggccatgactgaccagttgactgtctggtgcccagggcgcacgagctcggtgtacttgaggcgcgagtatgcgcgggtgtcaaagatgtaatcgttgcaggtgcgcaccaggtactggtagccaatgagaaagtgtggcggtggctggcggtacaggggccatcgctctgtagccggggctccgggggcgaggtcttccagcatgaggcggtggtagccgtagatgtacctggacatccaggtgataccggaggcggtggtggatgcacgtgggaactcgcgcacgcggttccagatgttgcgcagcggcatgaagtagttcatggtaggcacggtctggccagtgaggcgcgcgcagtcattgacgctctgtagacacggagaaaacgaaagcgatgagcggctcgactccgtggtctgggggaacgtgaacgggttgggtcgcggtgtaccccggttcgagtccaaagctaagcgatcacgctcggatcggccggagccgcggctaacgtggtattggctatcccgtctcgacccagccgacgaatatccagggtacggagtagagtcgtttttgctgctttttcctggacgtgtgccattgccacgtcaagctttagaacgctcagttctcgggccgtgagtggctcgcgcccgtagtctggagaatcagtcgccagggttgcgttgcggtatgccccggttggagcctaagcgcggctcgtatcggccggtttccgcgacaagcgagggtttggcagccccgttatttccaagaccccgccagccgacttctccagtttacgggagcgagcccttttttttttttttttgtttttgtcgcccagatgcatccagtgctgcgacagatgcgcccccagcaacaggccccttctcagcaacagccacaaaaggctcttcttgctcctgcaactactgcagctgcagccgtgagcggcgcgggacagcccgcctatgatctggacttggaagagggcgagggattggcgcgcctgggggctccatcgcccgagcggcacccgcgggtgcaactaaaaaaggactctcgcgaggcgtacgtgccccagcagaacctgttcagggacaggagcggcgaggagccagaggagatgcgagcatctcgatttaacgcgggtcgcgagctgcgccacggtctggatcgaagacgggtgctgcaagacgaggattttgaggtcgatgaagtcacagggatcagcccagctagggcacatgtggccgcggccaacctagtctcggcctacgagcagaccgtgaaggaggagcgcaacttccaaaaatcttttaacaaccatgtgcgcaccctgatcgcccgcgaggaagtgaccctgggtctgatgcatctgtgggacctgatggaggctatcgcccaaaaccccactagcaaaccactgacagctcagctgtttctggtggttcaacatagcagggacaacgaggcattcagggaggcgttgttgaacatcaccgagcctgatgggagatggctgtatgatctgatcaacatcctgcaaagtattatagtgcaggaacgtagcctgggtttggctgagaaagtggcagctatcaactactcggtcttgagcctgggcaaatactacgctcgcaagatctacaagaccccctacgtacccatagacaaggaggtgaagatagatgggttttacatgcgcatgactctgaaggtgctgactctgagcgacgatctgggggtgtatcgcaatgacaggatgcaccgcgcggtgagcgccagcaggaggcgcgagctgagcgacagagaacttatgcacagcttgcaaagagctctaacgggggccgggactgatggggagaactactttgacatgggagcggatttgcaatggcaacccagtcgcagggccatggaggctgcagggtgtgagcttccttacatagaagaggtggatgaagtcgaggacgaggagggcgagtacttggaagactgatggcgcgacccgtatttttgctagatggaacagcagcaggcaccggaccccgcaatgcgggcggcgctgcagagccagccgtccggcattaactcctcggacgattggacccaggccatgcaacgcataatggcgctgacgacccgcaaccccgaagcctttagacagcaaccccaggccaaccgcctttctgccatactggaggccgtagtgccctcccgctccaaccccacccacgagaaggtcctggctatcgtgaacgcgctggtggagaacaaggccatccgtcccgatgaggccgggctggtatacaatgctctcttggagcgcgtggcccgttacaacagcagcaacgtgcaaaccaacctggaccggatggtgaccgatgtgcgcgaggccgtgtctcagcgcgagcgattccagcgcgacgccaacttggggtcgttggtagcgctaaacgctttcctcagcacccagcccgccaacgtgccccgtggtcagcaagactatacaaactttttgagtgcattgagactcatggtagctgaggtgccccagagcgaggtgtaccagtccgggccagattacttcttccagaccagcagacagggcttgcagacagtgaacctgactcaggctttcaagaacctgaagggtctgtggggagtgcacgccccagtaggggatcgcgcgaccgtgtctagcttgctgactcccaactcccgcctgctgctgctgctggtatccccctttactgacagcggtagcattgaccgcaactcgtacttgggctacctgcttaacctgtatcgcgaggccataggacagagccaggtggacgagcagacctatcaagaaatcacccaagtgagccgcgccctgggtcaggaagacacgggcagtttggaagccaccctgaacttcttgctaaccaaccggtcacagaagatccctcctcagtatgcgcttaccgctgaggaggagcggatcctcagatacgtgcaacagagcgttggactgttcctgatgcaggagggggcgacacctaccgccgcgctggacatgacagctcgaaacatggagcccagcatgtatgctagtaacaggcctttcattaacaaactgctggactacctgcacagggcggccgccatgaactctgattatttcaccaatgctatcctgaacccacactggctgcccccacctggtttctacactggcgagtacgacatgcccgaccccaatgacgggttcctgtgggacgatgtggacagcagcatattttccccgcctcccggttatacagtttggaagaaggaagggggcgatagaagacactcttccgtgtcgctatccggaacggctggtgctgccgcgaccgtgcccgaagctgcaagtcctttccctagcttgcccttttcactaaacagcgttcgcagcagtgaactggggagaataacccgcccgcgcttgatgggcgaggatgagtacttgaatgactctttgctgaggccagagagggaaaagaacttccccaacaatggaatagagagtctggtggataagatgagtagatggaagacctatgcgcaggatcacagagacgagcccaggatcttgggggctacaagcagaccgatccgtagacgccagcgccacgacaggcagatgggtcttgtgtgggacgatgaggactctgccgatgatagcagcgtgttggacttgggtggaagaggagggggcaacccgttcgctcatctgcgtcccagattcgggcgcatgttgtaaaagtgaaagtaaaataaaaaggcaactcaccaaggccatggcgaccgagcgtgcgttcgttcttttttgttatctgtgtctagtacgatgaggagacgagccgtgctaggcggagcggtggtgtatccggagggtcctcctccttcttacgagagcgtgatgcagcaacaggcggcgatgatacagcccccactggaggctcccttcgtacccccacggtacctggcgcctacggaagggagaaacagcattcgttactcggagctgtcgcccctgtacgataccaccaagttgtatctggtggacaacaagtcggcggacatcgcctccctgaactatcagaacgaccacagcaacttcctgaccacggtggtgcagaacaatgactttacccccacggaggctagcacccagaccatcaactttgacgagcggtcgcgatggggcggtcagctgaagaccatcatgcacaccaacatgcccaacgtgaacgagtacatgttcagcaacaagttcaaggcgagggtgatggtgtccagaaaagctcctgaaggtgttacagtaaatgacacctatgatcataaagaggatatcttgaagtatgagtggtttgagttcattttaccagaaggcaacttttcagccaccatgacgatcgacctgatgaacaatgccatcattgacaactacctggaaattggcagacagaatggagtgctggaaagtgacattggtgttaagtttgacactagaaatttcaggctcgggtgggaccccgaaactaagttgattatgccaggtgtctacacttatgaggcattccatcctgacattgtattgctgcctggttgcggggtagactttactgaaagccgacttagcaacttgcttggcatcaggaagagacatccattccaggagggtttcaaaatcatgtatgaagatcttgaagggggtaatattcctgcccttttggatgtcactgcctatgaggaaagcaaaaaggataccactactgaaacaaccacactggctgttgcagaggaaactagtgaagatgatgatataactagaggagatacctatataactgaaaaacaaaaacgtgaagctgcagctgctgaagttaaaaaagagttaaagatccaacctctagaaaaagacagcaagagtagaagctacaatgtcttggaagacaaaatcaacacagcctaccgcagttggtacctgtcctacaattacggtaaccctgagaaaggaataaggtcttggacactgctcaccacttcagatgtcacctgtggggcagagcaggtctactggtcgctccctgacatgatgcaagacccagtcaccttccgctccacaagacaagtcaacaactacccagtggtgggtgcagagcttatgcccgtcttctcaaagagtttctacaatgagcaagccgtgtactctcagcagctccgacaggccacttcgctcacgcacgtcttcaaccgcttccctgagaaccagatcctcatccgcccgccggcgcccacaattaccaccgtcagtgaaaacgttcctgctctcacagatcacgggaccctgccgttacgcagcagtatccggggagtccagcgcgtgaccgttactgacgccagacgccgcacctgtccctacgtttacaaggccctgggcatagtcgcgccgcgcgttctttcaagccgcactttctaaaaaaaaaaaaaatgtccattctcatctcgcccagtaataataccggttggggactgtatgcgcccaccaagatgtatggaggcgcccgcaagcgctctacccagcatcctgtgcgcgttcgcggtcatttccgcgctccctggggcgcactcaagggtcgtacccgcactcggaccacggtcgatgatgtgatcgaccaggtggtcgccgatgctcgtaattatactcctactgcgcctacatctactgtggatgcagttattgacagtgtggtggcagacgcccgcgcctatgctcgccggaagagccgaaggaggcgcatcgccaggcgccacagggctactcccgccatgcgagccgcaaaagctattctgcggagggccaaacgtgtggggcgaagagccatgcttagagcggccagacgcgcggcttcaggtgccagcagcggcaggtcccgcaggcgcgcggccacggcggcagcagcggccattgccaacatggcccaaccgcgaagaggcaatgtgtactgggtgcgtgatgccactaccggccagcgcgtgcccgtgcgcacccgcccccctcgcacttagaagatactgagcagtctccgatgttgtgtcccagcggcaagtatgtccaagcgcaaatacaaggaagagatgctccaggtcatcgcgcctgaaatctacggtccgccggtgaaggatgaaaaaaagccccgcaaaatcaagcgggtcaaaaataacaaaaaggaagaagatgacgatgatgggctggtggagtttgtgcgcgagttcgccccaagacggcgcgtgcagtggcgcgggcgcaaagtgcgtcaagtgctcagacccgggaccactgtggtttttacacctggcgagcgttccagcactacttttaaacggtcctatgatgaggtgtacggggatgacgatattcttgagcaggcggcagaccgccttgacgagtttgcttatggcaagcgcactagatccagtcccaaagaggaggctgtgtccattcctttggatcatggaaatcccacccccagcctcaaaccagtcaccctgcagcaagtgctgcccgtgcctgcgcggagaggcgtaaagcgcgagggtgaggacctatatcccaccatgcagctaatggtgcccaagcgccagaggctagaagacgtactggagaaaatgaaagtggatgccgatatccagcctgaggtcaaagtaagacctatcaaggaagtggcgccaggtttgggagtacaaaccttcgacatcaagattcccaccgagtccatggaagtgcagaccgaacctgcaaaacccaccacctcaattgaggtgcaaacggaaccctggatgcccgcgcccgttgccgcccccagcaccactcgaagatcacgacgaaagtacggcccagcaagtctgctaatgcccaactatgctctgcacccatccatcattcccactccgggttacagaggcactcgctactatcgaaaccggagcaacacctctcgccgccgcaaaccacctgcaagtcgcactcgccgtcgccgccgccgcaacactgccagcaaattgactcccgccgccctggtgcggagagtgtaccgcgatggtcgcgctgaacctctgacgctgccgcgcgcgcgctaccatccaagcatcaccacttaatgactgttgacgctgcctccttgcagatatggccctcacttgccgccttcgcgtccccattactggctaccgaggaagaaactcgcgccgtagaaggatgttggggcgagggatgcgccgccacagacgaaggcgcgctatcagcagacgattagggggtggctttttgccagctcttatacccatcatcgccgcagcgatcggggcgataccaggcatagcttcagtggcggttcaggcctcgcagcgccactaacattggaaaaaacttataaataaaaaatagaatggactctgacgctcctggtcctgtgactatgtttttgtagagatggaagacatcaatttttcatccctggctccgcgacacggcacgaggccgtacatgggcacctggagcgacatcggcacgagccaactgaacgggggcgccttcaattggagcagtatctggagcgggcttaaaaattttggctcgaccgtaaaaacctatgggaacaaagcttggaacagcagcacagggcaggctctgagaaataagcttaaggaacaaaacttccaacagaaggtggtcgatgggatcgcctctggtattaacggcgtagtggatctggccaaccaggctgtacaaaaacagataaacagccgcctggacccgccgcccgcaacccctggtgaaatggaagtggaggaagaacttcctccgctggaaaagcggggcgacaagcgtccgcgacccgagctagagcagacgctggtgacgcgcgcagacgagcccccttcatatgaggaggcagtaaagctcggaatgcccactaccaggcctgtagctcacatggctaccggggtgatgaaaccttctcagtcacatcgacccgccaccttggacttgcctcctccccctgcttctgcggcgcctgttcccaaacctgtcgctaccagaaagcccaccgccgtacagcccgtcgccgtagccagaccgcgtcctgggggcacaccgcgcccgaaagcaaactggcaaagtactctgaacagcatcgtgggtctgggcgtgcagagtgtaaagcgccgtcgctgctattaattaaatatggagtagcgcttaacttgcttgtctgtgtgtatgtatcatcaccacgccgccgcagcagaggagaaaggaagaggtcgcgcgccgaggctgagttgctttcaagatggccaccccatcgatgatgccccaatgggcatacatgcacatcgccggacaggatgcttcggagtacctcagtccgggtctggtgcagttcgcccgtgcaacagacacctacttcagtatggggaacaaatttagaaaccccacagtggcgcccacccacgatgtgaccaccgaccgtagccagcgcctgatgctgcgcttcgtgcccgttgaccgggaagacaatacctactcttacaaagttcgctacacgctggctgtaggcgacaacagagtgcttgacatggccagcacattctttgacattcggggggtgcttgatagaggtcctagcttcaagccatattccggcacagcttacaattcactcgctcctaagggcgcgcccaatacatctcagtggatagttacaacaaatggggacaatgcagtaactaccaccacaaacacatttggcattgcttccatgaagggagacaatattactaaagaaggtttgcaaattgggaaagacattaccactactgaaggagaagaaaagcccatttatgccgataaaacatatcagccagagcctcaagttggagaagaatcatggactgatactgatggaacaaatgaaaagtttggtggaagagcccttaaaccagctaccaacatgaagccatgctacgggtcttttgcaagacctacaaacataaaagggggccaagctaaaaacagaaaagtaaaaccaacaaccgaaggaggggttgaaactgaggaaccagatattgatatggaatttttcgatggtagagatgctgttgcaggagctttagcgcctgaaattgtgctttatacggaaaatgtaaatttggaaactccagacagtcatgtggtatataaaccagaaacgtctaataactctcatgcaaatttgggtcaacaagccatgcctaacagacccaattacattggcttcagggataacttcgtaggcctaatgtactacaacagtactggaaatatgggagttttggctggccaagcatcacaactgaatgcagtggttgacttgcaggacagaaatactgaactgtcatatcagcttttgcttgattctctgggagacagaaccagatacttcagcatgtggaatcaggctgtggacagttacgatcccgatgttcgcattattgaaaatcatggcatcgaggatgaactgcctaattactgttttcctctgaatggcataggaccagggcacacatatcaaggcattaaagttaaaaccgatgacactaatggatgggaaaaagatgctaatgttgctccagctaatgaaataaccataggcaacaacctggctatggaaattaatatccaagctaacctttggagaagttttctgtactctaatgtggctttgtaccttccagatgtttacaagtacacgccacctaacattactttgcccactaacaccaacacctatgagtacatgaacgggcgagtggtatccccatccctggttgattcatacatcaacattggcgccaggtggtctcttgacccaatggacaatgtgaatccattcaaccaccaccgcaatgctggtctgcgctacaggtccatgcttctgggaaatggtcgttatgtgcctttccacatacaagtgcctcagaaattctttgctgtcaagaacctacttcttctacctggctcctacacctacgagtggaacttccgaaaggatgtgaacatggtcctgcaaagttcccttggaaatgacctcagaacggatggtgctaccataagtttcaccagcatcaatctctatgccaccttcttccccatggctcacaacacagcttccacccttgaagccatgctgcgcaacgataccaatgatcagtcatttaacgactacctctctgcagctaacatgctttaccccattcctgccaatgcaaccaacattccaatttccatcccatctcgcaactgggcagccttcaggggctggtccttcaccagactcaaaaccaaggagactccatctcttggatcagggttcgatccctacttcgtatattctggatctattccctacctggatggcaccttttaccttaaccacactttcaagaaggtctccatcatgtttgactcctcagtcagctggcctggcaatgacaggctgttgagtccaaatgagtttgaaatcaagcgcactgtggacggggaaggatacaacgtggcacaatgcaacatgaccaaagactggttcctggttcagatgcttgccaattacaacattggctaccagggcttttacatccctgagggatacaaggatcgcatgtactcctttttcagaaacttccagcctatgagcaggcaggtggttgatgaggttaattacactgactacaaagccgtcaccttaccataccaacacaacaactctggctttgtagggtaccttgcacctactatgagacaaggggaaccttacccagccaattatccatacccgctcatcggaactactgccgttaagagtgtcacccagaaaaagttcctgtgcgacaggaccatgtggcgcattcccttctccagcaacttcatgtccatgggggcccttaccgacctgggacagaacatgctctatgccaactcagcccatgcgctggacatgacttttgaggtggatcccatggatgagcccaccctgctttatcttcttttcgaagtcttcgacgtggtcagagtgcaccagccacaccgcggcgtcatcgaggccgtctacctgcgcacaccgttctcggccggcaacgccaccacataagaagcctcttgcttcttgcaagcagcagctgcagccatgacatgcgggtccggaaacggctccagcgagcaagagctcaaagccatcgtccgagacctgggctgcggaccctatttcctgggaacctttgacaagcgtttcccggggttcatggcccccgacaagctcgcctgcgccatagtcaacactgccggacgcgagacggggggagagcactggctggcttttggttggaacccgcgctacaacacctgctacctttttgatccttttgggttctcggatgagcggctcaaacagatttaccagtttgagtacgaggggctcctgcgtcgcagtgcccttgctaccaaagaccgctgcatcaccctggagaagtctacccaaagcgtgcagggtccgcgctcagccgcctgtggacttttttgctgtatgttccttcatgcctttgtgcactggcccgaccgccccatggacggaaaccccaccatgaagttgctgactggggtgtccaacagcatgctccaatcaccccaagtccagcccaccctgcgccgcaaccaggaggtgctataccgcttcctaaacacccactcatcttactttcgttctcaccgcgcgcgcattgaaagggccaccgcgtttgaccgtatggatatgcaataagtcatgtaaaaccgtgttcaataaacagcactttatttttacatgcactgaggctctggttttgctcatttgtttcatcatttactcagaagtcgaatgggttctggcgggagtcagagtgacccgcgggcagggatacgttgcggaactgtaacctgttctgccacttgaactcggggattaccagcttgggaactggaatctcgggaaaggtgtcttgccacaactttctggtcagttgcatagcgccaagcaggtcaggagcagagatcttgaaatcacagttggggccggcattctggacacgggagttgcgatacactgggttgcaacactggaacactatcaacgctgggtgtcttacgcttgccaacacggttgggtcactgatggtagtcacatccaagtcttcagcattggccatcccaaagggggtcatcttacatgtctgcctgcccatcacgggagcgcagcctggcttgtggttgcaatcacaatgaatggggatcagcatcatcctggcttggtcgggagttatccctgggtacacagccttcatgaaggcttcgtactgcttaaaagcttcctgggccttacttccctcggtgtagaacatcccacaggacttgctggaaaattgattagtagtacagttggcatcattcacacaacagcgggcatcgttgttggccaactgaaccacatttctgccccagcggttttgggtgatcttggctctgtctggattctccttcatagcgcgctgcccgttctcgctcgccacatccatctcgataatgtggtccttctggatcatgatagtgccatgcaggcatttcaccttgccttcataatcggtgcatccatgagcccacagagcgcacccggtgcactcccaattattgtgggcgatctcagaataataatgtaccaatccctgcatgaatcttcccatcattgttgtcaaggtcttcatgctggtaaatgtcagcgggatgccacggtgctcctcgttcacatactggtggcagatacgcttgtattgctcgtgctgctctggcatcagcttgaaagaggttctcagatcattatccagcctgtacctttccattagcacagccatcacttccatgcccttctcccaggcagataccaggggcagactcaaaggattcctaacagcaataaaagtagctcctttagctatagggtcattcttgtcgatcttctcaacacttctcttgccatccttctcaatgatgcgcaccggggggtagctgaagcccacggccaccaactgagcctgttctctttcttcttcactatcctggctgatgtcttgcagagggacatgcttggtcttcctgggcttcttcttgggagggatcgggggaggactgttgctccgctccggagacagggatgactgcgaagtttcgcttaccaataccacctggctctcggtagaagaaccggaccccacacgacggtaggtgttcctcttcgggggcagaggtggaggcgactgagatgggctgcggtctggccttggaggcggatggctggcagagctcattccgcgttcgggggtgtgctcccggtggcggtcgcttgactgatttcctccgcggctggccattgtgttctcctaggcagagaaacaacagacatggaaactcagccatcactgccaacatcgctgcaagcaccatcacacctcgcccccagcagcgacgaggaggagagcttaaccaccccaccacccagtcccgctaccaccacctctaccctcgatgatgaggaggaggtcgacgcagcccaggagatgcaggcgcaggataatgtgaaaacggaagagattgaggcagatgtcgagcaggacccgggctatgtgacgccggcggagcaccaggaggagctgaaacgctttctagacagagaggatgacgaccgcccagagcatcaagcagatggcgtttaccaggaggctgggatcagggatcatgtcgccgactacctcaccggccttggtggggaggacgtgctcctcaaacatctagcaaggcagtcgatcatagttaaagacgcattgctcgatctcactgaagtgcccatcagtgtggaagagcttagccgcgcctacgagctgaacctcttttcgcctcaggtaccccccaagcggcagccaaacggcacctgcgaggccaaccctcgactcaacttctatccagcttttactatccccgaagtgttggccacctaccacatctttttcaagaaccaaaagattccagtctcctgccgcgccaaccgcacccgcgccgatgccctgctcaacttgggtccgggagctcgcttacctgatatagcttccttggaagaggttccaaagatctttgagggtctgggaagtgatgagacacgggccgcaaatgctctgcaacagggagagaatgacatggatgaacaccacagcgctctggtggaactggagggtgacaatgcccggattgcagtgctcaagcgcagtatcgtggtcacccattttgcctaccccgctgttaacctgccccccaaagttatgagcgctgtcatggaccatctgctcatcaaacgagcaagacctctttcagaaaaccagaacatgcaggatccagacgcctcggacgagggcaagccggtagtcagtgacgagcagctatctcgctggctgggtaccaactccccccgagatttggaagagaggcgcaagcttatgatggctgtagtgctagtaactgtggagctggagtgtctgcgccgctttttcaccgaccctgagaccctgcgcaagctagaggagaacctgcactacacctttagacatggcttcgtgcggcaggcatgcaagatctccaacgtggagcttaccaacctggtttcttacatgggcattttgcatgagaaccgactagggcagagcgtcctgcacaccacccttaaaggggaggcccgccgtgactacatccgagactgtgtctacctctacctctgccatacctggcaaactggtatgggtgtgtggcaacagtgtttggaagagcagaacctaaaagagctggacaagctcttgcagagatccctcaaagccctgtggacaggttttgatgagcgcaccgtcgcctcggacctggcagacatcatcttccccgagcgtctcagggttactctgcgaaacggcctgccagactttatgagccagagcatgcttaacaactttcgctctttcatcctggaacgctccggtatcctgcctgccacctgctgtgcgctgccctccgactttgtgcctctcacctaccgcgagtgcccaccgccgctatggagccactgctacctgttccgcctggccaactacctctcctaccactcggatgttatagaggatgtgagcggagacggcctgctggaatgccactgccgctgcaatctttgcacaccccaccgctcccttgcctgcaacccccagttgctgagcgagacccagattatcggcaccttcgagctgcagggtcccagaagtaaaggcgaggggtcttctccggggcagagtttgaaactgacaccggggctgtggacctccgcctacctgcgcaagtttcaccccgaggactaccatccctatgagatcaggttctatgaggaccaatcacatcctcccaaagtcgagctctcagcctgcgtcatcacccagggagcaattctggcccaattgcaagccatccaaaaatctcgccaagaatttctgctaaaaaagggaaacggggtctaccttgaccctcagaccggtgaggagctcaacacaaggttcccccaggatgtcccatcgccgaggaagcaagaagttgaaggtgcagctgtcgcccccagaggatatgaaggaagactgggacagtcaggcagaggaggagatggaagattgggacagccaggcagaggaggtggacagcctggaggaagacagtttggaggaggaagacgaggaggcagaggaggtggaagaagcaaccgccgccaaacagttgtcatcggcggcggagacaagcaagtccccagacagcagcacggctaccatctccgctccgggtcggggggcccagcggcggcccaacagtagatgggacgagaccgggcgattcccaaacccgaccaccgcttccaagaccggtaagaaggagcgacagggatacaagtcctggcgtggacataaaaacgctatcatctcctgcttgcatgaatgcgggggcaacatatccttcacccggcgatacctgctcttccaccacggtgtaaacttcccccgcaatatcttgcattactaccgtcacctccacagcccctactgcagtcagcaagtcccggcaaccccgacagaaaaatacagcagcgacaacggtgaccagaaaaccagcagttagaaaatccacaacaagtgcaccaggaggaggactgaggatcacagcgaacgagccagcgcagaccagagagctgaggaaccggatctttccaaccctctatgccattttccagcagagtcgggggcaagagcaggaactgaaagtaaaaaaccgatctctgcgctcgctcaccagaagttgtttgtatcacaagagcgaagaccaacttcagcgcactctcgaggacgccgaggctctcttcaacaagtactgcgcgctgactcttaaagagtagcccttgcccgcgctcattttgaaaacggcgggaatcacgtcacccttggcacctgtcctttgcccttgtcatgagtaaagagattcccacgccttacatgtggagctatcagccccaaatggggttggcagcaggcgcttcccaggactactccacccgcatgaattggcttagcgccgggccctcaatgatatcacgggttaatgatatacgagcttatcgaaaccagttactcctagaacagtcagctctcaccaccacaccccgtcaacaccttaatccccgaaattggcccgccaccctggtgtaccaggaaaatcccgctcccaccaccgtactacttcctcgagacgcccaggccgaagttcagatgactaacgcaggtgtacagctggcgggcggttccgccctatgtcgtcaccgacctcaacagagtataaaacgcctggtgattagaggccgaggtatccagctcaacgacgagtcggttagctcttcgcttggtctgcgaccagacggagtcttccaaatcgccggctgtgggagatcttccttcactcctcgtcaggctgtgctgactttggagagttcgtcctcgcagccccgctcgggcggcattggaactctccagtttgtggaggagtttactccctctgtctacttcaaccccttctccggctctcctggccagtacccggacgagttcataccaaacttcgacgcaatcagcgagtcagtggatggctatgattgatgtctaatggtggtgcggctgagctagctcgactgcgacacctagaccactgccgccgctttcgctgcttcgcccgggaactcaccgagttcatctacttcgaactctccgaggagcaccctcagggtccggcccacggagtgcggattaccatcgaagggggaatagactctcgcctgcatcgcatcttctcccagcggcccgtgctaattgaacgcgaccagggaaatacaaccatctccatctactgcatctgtaaccaccccggattgcatgaaagcctttgctgtcttgtttgtgctgagtttaataaaaactgagttaagaccctcctacggactaccgcttcttcaatcaggactttacaacaccaaccagatcttccagaagacccagacccttcctcctttcatccaggactctaactctaccttaccagcaccctccactactaaccttcccgaaacaaacaagcttgcatctcatctgcaacaccgcctttcacgaagccttctttctgccaatactaccactcccaaaaccggaggtgagctccgcggtcttcctactgacgacccctgggtggtagcgggttttgtaacgttaggagtagttgcgggtgggcttgtgctgatcctttgctacctatacacaccttgctgtgcatatttagtcatattgtgctgttggtttaagaaatgggggccatactagtcgtgcttgctttactttcgcttttgggtctgggctctgctaatctcaatcctctcgatcacgatccatgtttagacttcgacccagaaaactgcacacttacttttgcacccgacacaagccgtctctgtggagttcttattaagtgcggatgggactgcaggtccgttgaaattacacataataacaaaacatggaacaataccttatccaccacatgggagccaggagttccccagtggtatactgtctctgtccgaggtcctgacggttccatccgcattagtaacaacactttcattttttctgaaatgtgcgatctggccatgttcatgagcagacagtatgacctatggcctcccagcaaagagaacattgtggcattttccattgcttattgcttggtaacatgcatcatcactgctatcatttgtgtgtgcatacacttgcttatagttattcgccctagacaaagcaatgaggaaaaagagaaaatgccttaacctttttcctcataccttttctttacagcatggcttctgttacagctctaattattgccagcattgtcactgtcgctcacgggcaaacaattgtccatattaccttaggacataatcacactcttgtagggcccccaattacttcagaggttatttggaccaaacttggaagtgttgattattttgatataatttgcaacaaaactaaaccaatatttgtaatctgtaacagacaaaatctcacgttaattaatgttagcaaaatttataacggttactattatggttatgacagatccagtagtcaatataaaaattacttagttcgcataactcagcccaaattaacagtgccaactatgacaataattaaaatggctaataaagcattagaaaattttacatcaccaacaacacccaatgaaaaaaacattccaaattcaatgattgcaattattgcggcggtggcattgggaatggcactaataataatatgcatgctcctatatgcttgttactataaaaagtttcaacataaacaggatccactactaaattttaacatttaattttttatacagatgatttccactacaatttttatcattactagccttgcagctgtaacttatggccgttcacacctaactgtacctgttggctcaacatgtacactacaaggaccccaagaaggctatgtcacttggtggagaatatatgataatggagggttcgctagaccatgtgatcagcctggtacaaaattttcatgcaacggaagagacttgaccattattaacataacatcaaatgagcaaggcttctattatggaaccaactataaaaatagtttagattacaacattattgtagtgccagccaccacttctgctccccgcaaatccactttctctagcagcagtgccaaagcaagcacaattcctaaaacagcttctgctatgttaaagcttccaaaaatcgctttaagtaattccacagccgctcccaatacaattcctaaatcaacaattggcatcattactgccgtggtagtgggattaatgattatatttttgtgtataatgtactacgcctgctgctatagaaaacatgaacaaaaaggtgatgcattactaaattttgatatttaattttttatagaattatgatattgtttcaatcaaataccactacctcctatgcatacacaaacattcagcctaaatacgctatgcaactagaaatcacaatactaattgtaattggaattcttatactatctgttattctttattttatattctgccgtcaaatacccaatgttcatagaaattctaaaagacgtcccatctattctcctatgattagtcgtccccatatggctctgaatgaaatctaagatctttttttttttctcttacagtatggtgaacatcaatcatgatccctagaaatttcttcttcaccatactcatctgtgcttttaatgtctgtgctactttcacagcagtagccactgcaagcccagactgtataggaccatttgcttcctatgcactttttgccttcgttacttgcatctgcgtgtgtagcatagtctgcctggttattaattttttccaactggtagactggatctttgtgcgaattgcctacctacgtcaccatcccgaataccgcaatcaaaatgttgcggcacttcttaggcttatttaaaaccatgcaggctatgctaccagtcattttaattttgctactaccctgcattcccctagcttccaccgccactcgcgctacacctgaacaacttagaaaatgcaaatttcaacaaccatggtcatttcttgattgctaccatgaaaaatctgattttcccacatactggatagtgattgttggaataattaacatactttcatgtacctttttctcaatcacaatataccccacatttaattttgggtggaattctcccaatgcactgggttacccacaagaaccagatgaacatattccactacaacacatacaacaaccactagcactggtacagtatgaaaatgagccacaaccttcactgccccctgccattagttacttcaacctaaccggcggagatgactgacccaatcgccacatcatccaccgctgccaaggagctgctggacatggacggacgtgcctcagaacagcgactcatccaactacgcattcgtcagcagcaggaacgagcagtaaaagagctaagggatgccattgggattcaccagtgcaaaaaaggcatattctgcttagtaaaacaatccaaaatctcctacgagatcaccgctactgaccatcgtctctcatacgagctcggtccgcagcgacaaaaattcacctgcatggtgggaatcaaccccatagttatcacccagcagtctggagatactaagggttgtatccagtgttcctgtgattccaccgagtgcatctacacactgctgaagaccctctgcggccttcgagacctcctacccatgaactaatcattgcccctaccttacccaatcaaaatattaataaagacacttacttgaaatcagcaatacagtctttgtcaaaactttctaccagcagcacctcaccctcttcccaactctggtactctaaacgtcggagggtggcatactttctccacactttgaaagggatgtcaaattttatttcctcttctttgcccacaatcttcatttctttatccccagatggccaagcgagctcggctaagcacttccttcaacccggtgtacccttatgaagatgaaagcagctcacaacacccatttataaatcctggtttcatttcccctgacgggttcacacaaagtccaaacggggttttaagtcttaaatgtgttaatccacttaccactgcaagcggctccctccaacttaaagtgggaagtggtcttacagtagacactactgatggatccttagaagaaaacatcaaagttaacacccccctaacaaagtcaaaccattctataaatttaccaataggaaacggtttgcaaatagaacaaaacaaactttgcagtaaactcggaaatggtcttacatttgactcttccaattctattgcactgaaaaataacactttatggacaggtccaaaaccagaagccaactgcataattgaatacgggaaacaaaacccagatagcaaactaactttaatccttgtaaaaaatggaggaattgttaatggatatgtaacgctaatgggagcctcagactacgttaacaccttatttaaaaacaaaaatgtctccattaatgtagaactatactttgatgccactggtcatatattaccagactcatcttctcttaaaacagatctagaactaaaatacaagcaaaccgctgactttagtgcaagaggttttatgccaagtactacagcgtatccatttgtccttcctaatgcgggaacacataatgaaaattatatttttggtcaatgctactacaaagcaagcgatggtgccctttttccgttggaagttactgttatgcttaataaacgcctgccagatagtcgcacatcctatgttatgacttttttatggtccttgaatgctggtctagctccagaaactactcaggcaaccctcataacctccccatttaccttttcctatattagagaagatgactgacaacaaaaataaagttcaacattttttattgaaattccttttacagtattcgagtagttattttgcctcccccttcccatttaacagaatacaccaatctctccccacgcacagctttaaacatttggataccattagagatagacatagttttagattccacattccaaacagtttcagagcgagccaatctggggtcagtaatacataaaaatgcatcgggatagtcttttaaagcgctttcacagtccaactgttgcggatgcgactccggagtctgaatcacggtcatctggaagaagaacgatgggaatcataatccgaaaacggaatcgggcgattgtgtctcatcaaacccacaagcaaccgctgtctgcgtcgctccgtgcgactgctgtttatgggatcggggtccgcagtgtcctgaagcatgattttaatagcccttaacattaactttctggtgcgatgcgcgcagcaacgcattctgatttcacttagattactacagtaggtacagcacattatcacaatattgtttaataaaccataattaaaagcgctccagccaaaactcatatctgatataatcgcccctgcatgaccatcataccaaagtttaatataaattaaatgtcgttccctcaaaaacacactacccacatacatgatctcttttggcatgtgcatattaacaatttgtctgtaccatggacaacgttggttaatcatgcaacccaatataaccttccggaaccacactgccaacaccgctcccccagccatgcattgaagtgaaccctgctgattacaatgacaatgaagaacccaattctctcgaccatgaatcacttgagactgaaaaatatctatagtagcacaacaaagacataaatgcatgcatcttctcataatttttaactcctctggatttaaaaacatatcccaaggaatgggaaactcttgcagaacagtaaagctggcagaacaaggaagaccacgaacacaacttacactatgcatagtcatagtatcacaatctggcaacagcgggtggtcttcagtcatagaagctcgggtttcattttcctcacatcgtggtaattgggctctggtgtaagggtgatgtctggcgcatgatgtggagcgtgcgcgcaaccttgtcataatggagttgcttcctgacattctcgtattttgtatagcaaaacgctgccctggcacaacacactcttcttcgtcttctatcctgccgcttagtgtgttccgtctgataattcaagtacagccacactcttaagttggtcaaaagaatgctggcttcagttgtaatcaaaactccatcatatttaattgttctaaggaaatcatccacggtagcatatgcaaatcccaaccaagcaatgcaactggattgcgtttcaagcagcagaggagagggaagagacggaagaatcatgttaatttttattccaaacgatctcgcagtacttcaaattgtagatcgcgcagatggcatctatcgcccccactgtgttggtgaaaaagcacagctaaatcaaaagaaatgcgattttcaaggtgctcaacggtggcttccaacaaagcctccacgcgcacatccaaaaacaaaagaataccaaaagaaggagcattttctaactcctcaaacatcatattacattcctgcaccattcccagataattttcagctttccagccttgaattattcgtgtcagttcttgtggtaaatccaaaccacacattacaaacaggtcccggagggcgccctccaccaccattcttaaacacaccctcataatgacaaaatatcttgctcctgtgtcacctgtagcaaattaagaatggcatcatcaattgacatgcccttggctctaagttcttctctaagttctagttgtagatactctctcatattatcaccaaactgcttagccagaagccccccgggaacaatagcaggggacgctacagtgcagtacaagcgcagacctccccaattggctccagcaaaaacaagattagaataagcatactgggaaccaccagtaatatcatcaaagttgctggaaatataatcaggcagagtttcttgtaaaaattgaataaaagaaaaattttccaaagaaacattcaaaaccgttgggatgcaaatacaataggttaccgcgctgcgctccaacattgttagttttgaattagtctgcaaaataaaagaaacaagcgtcatatcatagtagcctgtcgaacaggtggaaaaatcagtctttccatcacaagacaagccacagggtctccagctcgaccctcgtaaaacctgtcattgtgattaaacaacagcaccgaaagttcctcgcggtggccagcatgaataattcttgatgaagcatacaatccagacatgttagcatcagttaaagagaaaaaacagccaacatagcctctgggtataattatgcttaattttaagtatagcaaagccacccctcgcggatacaaagtaaaaggcacaggagaataaaaaatataattatttctctgctgctgttcaggcaacgttgctcccggtccctctaaatagacatacaaagcctcatcagccatggcttaccaggcaaagtacagcgggcgcacaaagcacaagctctaaagaagctctaaaaacactctccaacctctccacaatatatacacaagccctaaactgacgtaatgggagtaaagtgaaaaaaaaataccgccaagcccaacacacaccccgaaactgcgtcagcaggaaaaagtacagtttcacttccgcattcccaacaagcgtaacttcctctttctcatggtacgtcacatccgattaacttgcaacgtcattttcccacggtcgcgccgccccttttagccgttaaccccgcagccaatcaccacacagcgcgcacttttttaaattacctcatttacatgttggcaccattccatctataaggtatattatatagatag

SEQ ID NO: 140 - DNA, 35083 bp, Human adenovirus type 9
ctatctatataatataccccacaaagtaaacaaaagttaatatgcaaatgagcttttgaattttaacggtttcggggcggagccaacgctgattggacgagagaagacgatgcaaatgacgtcacgacgcacggctaacggtcgccgcggaggcgtggcctagcccggaagcaagtcgcggggctgatgacgtataaaaaagcggactttagacccggaaacggccgattttcccgcggccacgcccggatatgaggtaattctgggcggatgcaagtgaaattaggtcattttggcgcgaaaactgaatgaggaagtgaaaagcgaaaaataccggtccctcccagggcggaatatttaccgagggccgagagactttgaccgattacgtgggggtttcgattgcggtgtttttttcgcgaatttccgcgtccgtgtcaaagtccggtgtttatgtcacagatcagctgatccgcagggtatttaaaccagtcgagtccgtcaagaggccactcttgagtgccagcgagtagagatttctctgagctccgctcccagagaccgagaaaaatgagacacctgcgcctcctgccttcaactgtgcccggtgagctggctgtgcttatgctggaggactttgtggatacagtattggaggacgaactgcatccaagtccgttcgagctgggacccacacttcaggatctctatgatctggaggtagatgcccatgatgacgaccctaacgaggaggctgtgaatttaatatttccagaatctatgattcttcaggctgacatagccaacgaatctactccacttcatacaccgactctgtcacccatacctgaattggaagaggaggacgaactagacctccggtgttatgaggaaggttttcctcccagcgattcagaggatgaacggggtgagcagaccatggctctgatctcagactatgcttgtgtgattgtggaggagcaagatgtgattgaaaaatctactgagccagtacaaggctgtaggaactgccagtaccaccgggataagtccggagatgtgaacgcctcctgcgctttgtgctatatgaaacagactttcagctttatttacagtaagtggagtgaatgtgagagaggctgagtgcttaacacataactgtaatgcttgaacagctgtgctaagtgtggtttattttgttactaggtccggtgtcagaggatgagttatcaccctcagaagaagaccacccgtctccccctgagctgtcaggcgaaacgcccctgcaagtgttcagacccaccccagtcagacccagtggcgagaggcgagcggctgttgacaaaattgaggacttgttgcaggacatgggtggggatgaacctttggacctgagcttgaaacgccccaggaactagacgcagctgcgcttagtcatgtgtaaataaagttgtacaataaaagtctatgtgacgcatgcaaggtgtggtttatgactcatgggcggggcttagtcctatataagtggcaacacctgggcacttgggcacagaccttcagggagttcctgatggatgtgtggactatccttgcagactttagcaagacacgccggcttgtagaggatagttcagacgggtgctccgggttctggagacactggtttggaactcctctatctcgcctggtgtacacagttaagaaggattataaagaggaatttgaaaatatttttgctgactgctctggcctgctagattctctgaatcttggccaccagtcccttttccaggaaagggtactccacagccttgatttttccagcccagggcgcactacagccggggttgcttttgtggtttttctggttgacaaatggagccaggacacccaactgagcaggggctacatcctggacttcgcagccatgcacctgtggagggcctggatcaggcagcggggacagagaatcttgaattactggcttctacagccagcagctccgggtcttcttcgtctacacagacaaacatccatgttggaggaagaaatgaggcaggccatggacgagaacccgaggagcggcctggaccctccgtcggaagaggagctggattgaatcaggtatccagcctgtacccagagcttagcaaggtgctgacatccatggccaggggagttaagagggagaggagcgatgggggtaataccgggatgatgaccgagctgacggccagcctgatgaatcggaagcgcccagagcgccttacctggtacgagctacagcaggagtgcagggatgagttgggcctgatgcaggataaatatggcctggagcagataaaaacccattggttgaacccagatgaggattgggaggaggctattaagaagtatgccaagatagccctgcgcccagattgcaagtacatagtgaccaagaccgtgaatatcagacatgcctgctacatctcggggaacggggcagaggtggtcatcgataccctggacaaggccgccttcaggtgttgcatgatgggaatgagagcaggagtgatgaatatgaattccatgatcttcatgaacatgaagttcaatggagagaagtttaatggggtgctgttcatggccaacagccacatgaccctgcatggctgcagtttcttcggcttcaacaatatgtgcgcagaggtctggggcgcttccaagatcaggggatgtaagttttatggctgctggatgggcgtggtcggaagacccaagagcgagatgtctgtgaagcagtgtgtgtttgagaaatgctacctgggagtctctaccgagggcaatgctagagtgagacactgctcttccctggagacgggctgcttctgcctggtgaagggcacagcctctctgaagcataatatggtgaagggctgcacggatgagcgcatgtacaacatgctgacctgcgattcgggggtctgccatatcctgaagaacatccatgtgacctcccaccccagaaagaagtggccagtgtttgagaataacctgctgatcaagtgccatatgcacctgggagccagaaggggcaccttccagccgtaccagtgcaactttagccagaccaagctgctgttggagaacgatgccttctccagggtgaacctgaacggcatctttgacatggatgtctcggtgtacaagatcctgagatacgatgagaccaagtccagggtgcgcgcttgcgagtgcgggggcagacacaccaggatgcagccagtggccctggatgtgaccgaggagctgagaccagaccacctggtgatggcctgtaccgggaccgagttcagctccagtggggaggacacagattagaggtaggtcgagtgagtagtgggcgtggctaaggtgactataaaggcgggtgtcttacgagggtctttttgcttttctgcagacatcatgaacgggaccggcggggccttcgaaggggggctttttagcccttatttgacaacccgcctgccgggatgggccggagttcgtcagaatgtgatgggatcgacggtggatgggcgcccagtgcttccagcaaattcctcgaccatgacctacgcgaccgtggggagctcgtcgctcgacagcaccgccgcagccgcggcagccgcagctgccatgacagcgacgagactggcctcgagctacatgcccagcagcggcagcagcccctctgtgcccagttccatcatcgccgaggagaaactgctggccctgctggccgagctggaagccctgagccgccagctggccgccctgacccagcaggtgtccgagctccgcgagcagcaacagcagcaaaataaatgattcaataaacacagattctgattcaaacagcaaagcatctttattatttattttttcgcgcgcggtaggccctggtccacctctcccgatcattgagagtgcggtggattttttccaggacccggtagaggtgggattggatgttgaggtacatgggcatgagcccgtcccgggggtggaggtagcaccactgcatggcctcgtgctctggggtcgtgttgtagatgatccagtcatagcaggggcgctgggcgtggtgctggatgatgtctttgagaaggagactgatggccacggggagccccttggtgtaggtattggcgaagcggttgagctgggagggatgcatgcggggggagatgatgtgcagtttggcctggatcttgaggttggcgatgttgccacccagatcccgccgggggttcatgttgtgcaggaccaccaggacggtgtagcccgtgcacttggggaacttgtcatgcaacttggaagggaatgcgtggaagaatttggagacgcccttgtgcccgcccaggttttccatgcattcatccatgatgatggcgatgggcccgtgggctgcggctttggcaaagacgtttctggggtcagatacatcataattatgctcctgggtgagatcatcataagacattttaatgaatttggggcggagggtgccagattgggggacgatggttccctcgggccccggggcgaagttcccctcacagatctgcatctcccaggctttcatctcggagggggggatcatgtccacctgcggggcgatgaaaaaaacggtttccggggctggggtgatgagctgcgaagagagcaggtttctcaacagctgggacttgccgcacccggtcgggccgtagatgaccccgatgacgggttgcaggtggtagttcaaggacatgcagctgccgtcgtcccggaggaggggggccacctcgttgagcatgtctctgacttggaggttttcccgaacgagctcgccgaggaggcggtccccgcccagcgagaggagctcttgcagggaagcaaagtttttcaggggcttgagtccgtcggccatgggcatcttggcgagggtctgcgagaggagctccaggcggtcccagagctcggtgacgtgctctacggcatctcgatccagcagacttcctcgtttcgggggttgggacgactgcgactgtagggcacgagacgatgggcgtccagcgcggccagcgtcatgtccttccagggtctcagggtccgagtgagggtggtctccgtcacggtgaaggggtgggcccctggctgggcgcttgcaagggtgcgcttgagactcatcctgctggtgctgaaacgggcacggtcttcgccctgcgagtcggcgagatagcagttgaccatgagctcgtagttgagggcctcggcggcgtggcccttggcgcggagcttgcccttggaagagcgcccgcaggcgggacagaggagggattgcagggcgtagagcttgggggcgagaaagacggactcgggagcgaaagcgtccgctccgcagtgggcgcagacggtctcgcactcgacgagccaggtgagctctggctgctcggggtcaaaaaccagttttcccccgttctttttgatgcgcttcttacctcgcgtctccatgagtctgtgtccgcgctcggtgacaaacaggctgtcggtgtccccgtagacggacttgattggcctgtcctgcaggggcgtcccgcggtcctcctcgtagagaaactcggaccactctgagacaaaggcgcgcgtccacgccaagacaaaggaggccacgtgcgaggggtagcggtcgttgtccactagggggtccaccttttccaccgtgtgcagacacatgtccccctcctccgcatccaagaaggtgattggcttgtaggtgtaggccacgtgaccgggggtccccgacgggggggtataaaagggggcgggtctgtgctcgtcctcactctcttccgcgtcgctgtccacgagcgccagctgttggggtaggtattccctctcgagagcgggcatgacctcggcactcaggttgtcagtttctagaaacgaggaggatttgatgttggcttgccctgccgcgatgctttttaggagactttcatccatctggtcagaaaagactatttttttattgtcaagcttggtggcgaaggagccatagagggcgttggatagaagcttggcgatggatctcatggtctgatttttgtcacggtcggcgcgctccttggccgcgatgtttagctggacatactcgcgcgcgacgcacttccattcggggaagacggtggtgcgctcgtcgggcacgatcctgacgcgccagccgcggttatgcagggtgaccaggtccacgctggtggccacctcgccgcgcaggggctcgttggtccagcagagtctgccgcccttgcgcgagcagaacgggggcagcacatcaagcagatgctcgtcaggggggtccgcatcgatggtgaagatgcccggacagagttccttgtcaaaataatcgatttttgaggatgcatcatccaaggccatctgccactcgcgggcggccagcgctcgctcgtaggggttgaggggcggaccccagggcatgggatgagtgagggcggaggcgtacatgccgcagatgtcgtagacatagatgggctccgagaggatgccgatgtaggtgggataacagcgccccccgcggatgctggcgcgcacgtagtcatacaactcgtgcgagggggccaagaaggcggggccgagattggtgcgctggggctgctcggcgcggaagacgatctggcgaaagatggcgtgcgagttggaggagatggtgggccgttggaagatgttaaagtgggcgtggggcaagcggaccgagtcgcggatgaagtgcgcgtaggagtcttgcagcttggcgacgagctcggcggtgacgaggacgtccatggcgcagtagtccagcgtttcgcggatgatgtcataacccgcctctcctttcttctcccacagctcgcggttgagggcgtactcctcgtcatccttccagtactcccggagcgggaatcctcgatcgtccgcacggtaagagcccagcatgtagaaatggttcacggccttgtagggacagcagcccttctccacggggagggcgtaagcttgagcggccttgcggagcgaggtgtgcgtcagggcgaaggtgtccctgaccatgactttcaagaactggtacttgaaatccgagtcgtcgcagccgccgtgctcccagagctcgaaatcggtgcgcttcttcgagagggggttaggcagagcgaaagtgacgtcattgaagagaatcttgcctgctcgcggcatgaaattgcgggtgatgcggaaagggcccgggacggaggctcggttgttgatcacctgggcggcaaggacgatctcgtcgaagccgttgatgttgtgcccgacgatgtagagttccatgaatcgcgggcggcctttgatgtgcggcagctttttgagctcctcgtaggtgaggtcctcggggcattgcaggccgtgctgctctagcgcccactcctggagatgtgggttggcttgcatgaaggaagcccagagctcgcgggccatgagggtctggagctcgtcgcgaaagaggcggaactgctggcccacggccatcttttctggggtgacgcagtagaaggtgagggggtcccgctcccagcgatcccagcgtaagcgcacggcgagatcgcgagcgagggcgaccagctcgggttcccccgagaatttcatgaccagcatgaaggggacgagctgcttgccgaaggaccccatccaggtgtaggtttctacatcgtaggtgacaaagagccgctccgtgcgaggatgagagccgattgggaagaactggatttcctgccaccagttggacgagtggctgttgatgtgatgaaagtagaaatcccgccggcgaaccgagcactcgtgctgatgcttgtaaaagcgtccgcagtactcgcagcgctgcacgggctgtacctcatccacgagatacacagcgcgtcccttgaggaggaacttcaggagtggcggccctggctggtggctttcatgttcgcctgcgtgggactcaccctggggctcctcgaggacggagaggctgacgagcccgcgcgggagccaggtccagatctcggcgcggcgggggcggagagcgaagacgagggcgcgcagttgggagctgtccatggtgtcgcggagatccaggtccgggggcagggttctgaggttgacctcgtagaggcgggtgagggcgtgcttgagatgcagatggtacttgatctccacgggtgagttggtggtcgtgtccacgcattgcatgagcccgtagctgcgcggggccacgaccgtgccgcggtgcgcttttagaagcggtgtcgcgggcgtgctcccggcggcagcggcggttctggccccgcgggcaggggcggcagaggcacgtcggcgtggcgctcgggcaggtcccggtgctgcgccctgagagcgctggcgtgcgcgacgacgcggcggttgacatcctggatctgccgcctctgcgtgaagaccacgggccccgtgactttgaacctgaaagacagttcaacagaatcaatctctgcgtcattgacggcggcctgacgcaggatctcttgcacgtcgcccgagttgtcctggtaggcgatctcggtcatgaactgttcgatctcctcctcctggagatcgccgcggcccgcgcgctccacggtggcggcgaggtcattggagatgcggcccatgagctgcgagaaggcgcccaggccgctctcgttccagacgcggctgtagaccacgtccccgtcggcgtcgcgtgcgcgcatgaccacctgcgcgaggttgagctccacgtgccgcgtgaagacggcgtagttgcgcaggcgctggaagaggtagttgagggtggtggcgatgtgctcggtgacgaagaagtacatgatccagcggcgcaggggcatctcgctgatgtcgccgatggcctccagcctttccatggcctcgtagaaatccacggcgaagttgaaaaactgggcattgcgggccgagaccgtgagctcgtcttccaggagccggatgagctcggcgatggtggcgcgcacctcgcgctcgaaatccccgggggcctcctcttcttcctcttcttccatgacgacctcttcttctatttcttcctctgggggcggtggtggtggcggggcccgacgacgacggcgacgcaccgggagacggtcgacgaagcgctcgatcatctccccgcggcggcgacgcatggtttcggtgacggcgcgaccccgttcgcgaggacgcagcgtgaagacgccgccggtcatctcccggtaatggggcgggtccccgttgggcagcgatagggcgctgacgatgcatcttatcaattgcggtgtaggggacgtgagcgcgtcgagatcgaccggatcggagaatctttcgaggaaagcgtctagccaatcgcagtcgcaaggtaagctcaaacacgtagcagccctgtggacgctgttagaattgcggttgctgatgatgtaattgaagtaggcgtttttgaggcggcggatggtggcgaggaggaccaggtccttgggtcccgcttgctggatgcggagccgctcggccatgccccaggcctggccctgacaccggctcaggttcttgtagtagtcatgcatgagcctctcgatgtcatcactggcggaggcggagtcttccatgcgggtgaccccgacgcccctgagcggctgcacgagcgccaggtcggcgacgacgcgctcggcgaggatggcctgttgcacgcgggtgagggtgtcctggaagtcgtccatgtcgacaaagcggtggtaggccccggtgttgatggtgtaggtgcagttggccatgagcgaccagttgacggtctgcaggccgggttgcacgacctcggagtacctgagccgcgagaaggcgcgcgagtcgaagacgtagtcattgcaggtgcgcacgaggtactggtagccgactaggaagtgcggcggcggctggcggtagagcggccagcgctgggtggccggcgcgcccggggccaggtcctcgagcatgaggcggtggtagccgtagaggtagcgggacatccaggtgatgccggcggcggtggtggaggcgcgcgggaactcgcggacgcggttccagatgttgcgcagcggcaggaaatagtccatggtcggcacggtctggccggtgagacgcgcgcagtcattgacgctctagaggcaaaaacgaaagcggttgagcgggctcttcctccgtagcctggcggaacgcaaacgggttaggccgcgtgtgtaccccggttcgagtccccttgaatcaggctggagccgcgactaacgtggtattggcactcccgtctcgacccgagcccgatagccgccaggatacggcggagagtcctttttgccggccaaggggggtcgctagacttgaaagcgaccgaaaaccctgccgggtagtggctcgcgcccgtagtctggagaagcatcgccagggttgagtcgcggcagaacccggttcgcggacggccgcggcgagcgggacttggtcaccccgccgatttaaagacccacagccagccgacttctccagttacgggagcgagcccccttttttctttttgccagatgcatcccgtcctgcgccaaatgcgtcccacccccccggcgaccaccgcgaccgcggccgtagcaggcgccggcgctagccagccacagccacagacagagatggacttggaagagggcgaagggctggcgagactgggggcgccgtccccggagcgacacccccgcgtgcagctgcagaaggacgtgcgcccggcgtacgtgcctgcgcagaacctgttcagggaccgcagcggggaggagcccgaggagatgcgcgactgccggtttcgggcgggcagggagctgcgcgagggcctggaccgccagcgcgtgctgcgcgacgaggatttcgagccgaacgagcagacggggatcagccccgcgcgcgctcacgtggcggcggccaacctggtgacggcctacgagcagacggtgaagcaggagcgcaacttccaaaagagtttcaacaaccacgtgcgcaccctgatcgcgcgcgaggaggtggccctgggcctgatgcacctgtgggacctggcggaggccatcgtgcagaacccggacagcaagcctctgacggcgcagctgttcctggtggtgcagcacagcagggacaacgaggcgttcagggaggcactgctgaacatcgccgagcccgagggtcgctggctgctggagctgatcaacatcttgcagagcatcgtagtgcaggagcgcagcctgagcttggccgagaaggtggcggcgatcaactactcggtgctgagcctgggcaagttttacgcgcgcaagatttacaagacgccgtacgtgcccatagacaaggaggtgaagatagacagcttttacatgcgcatggcgctcaaggtgctgacgctgagcgacgacctgggcgtgtaccgcaacgaccgcatccacaaggccgtgagcacgagccggcggcgcgagctaagcgaccgcgagctgatgctgagcctgcgccgggcgctggtagggggcgctgccggcggcgaggagtcctacttcgacatgggggcggacctgcattggcagccgagccggcgcgccttggaggccgcctacggtccagaggacttggatgaggaagaggaagaggaggaggatgcacccgctgcggggtactgacgcctccgtgatgtgtttttagatgcagcaagccccggaccccgccataagggcggcgctgcaaagccagccgtccggtctagcatcggacgactgggaggccgcgatgcaacgcatcatggccctgacgacccgcaaccccgagtcctttagacaacagccgcaggccaacagactctcggccattctggaggcggtggtcccctctcggaccaaccccacgcacgagaaggtgctggcgatcgtgaacgcgctggcggagaacaaggccatccgtcccgacgaggccgggctggtgtacaacgccctgctggagcgcgtgggccgctacaacagcacgaacgtgcagtccaacctggaccggctggtgacggacgtgcgcgaggccgtggcgcagcgcgagcggttcaagaacgagggcctgggctcgctggtggcgctgaacgccttcctggcgacgcagccggcgaacgtgccgcgcgggcaggacgattacaccaactttatcagcgcgctgcggctgatggtgaccgaggttccccagagcgaggtgtaccagtcgggcccggactactttttccagacgagccggcagggcttgcagacggtgaacctgagccaggctttcaagaacctgcgagggctgtggggcgtgcaggcgcccgtgggcgaccggtcgacggtgagcagcttgctgacgcccaactcgcggctgctgctgctgctgatcgcgcccttcaccgacagcggcagcgtgaaccgcaactcgtacctgggccatctgctgacgctgtaccgcgaggccataggccaggcgcaggtggacgagcagaccttccaggagatcactagcgtgagccgcgcgctggggcagaacgacaccgacagtctgagggccaccctgaacttcttgctgaccaatagacagcagaagatcccggcgcaatatgcgctgtcggccgaggaggaaaggatcctgagatatgtgcagcagagcgtagggctgttcctgatgcaggagggggccacccccagcgccgcgctggacatgaccgcgcgcaacatggaacctagcatgtacgccgccaaccggccgttcatcaataagctgatggactacctgcaccgcgcggcggtcatgaacacggactactttacaaacgccatcctgaacccgcactggctcccgccgccggggttctacacgggcgagtacgacatgcccgaccccaacgacgggttcctgtgggacgacgtggacagcgtggtgttctcgccgacctttcaaaagcgccaggaggcgccgccgagcgagggcgcggtggggaggagcccctttcctagcttagggagtttgcatagcttgccgggctcggtgaacagcggcagggtgagccggccgcgcttgctgggcgaggacgagtacctgaacgactcgctgctgcagccgccgcgggccaagaacgccatggccaataacgggatagagagtctggtggacaaactgaaccgttggaagacctacgctcaggaccatagggatgcgcccgcgccgcggcgacagcgccacgaccggcagcggggcctggtgtgggacgacgaggactcggccgacgatagcagcgtgttggacttgggcgggagcggtggggtcaacccgttcgcgcatctgcagcccaaactggggcgacggatgttttgaaatgcaaaataaaactcaccaaggccatagcgtgcgttctcttccttgttagagatgaggcgtgcggtggtgtcttcctctcctcctccctcgtacgagagcgtgatggcgcaggcgaccctggaggttccgtttgtgcctccgcggtatatggctcctacggagggcagaaacagcattcgttactcggagctggctccgcagtacgacaccactcgcgtgtacttggtggacaacaagtcggcggacatcgcttccctgaactaccaaaacgaccacagcaacttcctgaccacggtggtgcagaacaacgatttcacccccgccgaggccagcacgcagacgataaattttgacgagcggtcgcggtggggcggtgatctgaagaccattctgcacactaacatgcccaatgtgaacgagtacatgttcaccagcaagtttaaggcgcgggtgatggtggctaggaagcatccagagggggtagttgaaacagatttgagtcaggataagcttgaatatgagtggtttgagtttaccctgcccgagggaaacttttccgagaccatgaccatagacctgatgaacaacgccatcttggaaaactacttgcaagtggggcggcaaaatggcgtgctggagagcgatatcggagtcaagtttgacagcagaaatttcaagctgggctgggacccggtgaccaagctggtgatgccaggggtctacacctacgaggccttccacccggacgtggtgctgctgccgggctgcggggtggacttcaccgagagccgcctgagcaacctcctgggcattcgcaagaagcaacctttccaagagggcttcagaatcatgtatgaggatctagaaggtggcaacatccccgccctccttgatgtgcccaagtacttggaaagcaagaagaaagttgaagacgaaactaaaaatgcagctgcggctacagccgatacaaccactaggggtgatacatttgcaactccagcgcaagagacagcagctgataagaaggtagaagtcttgcccattgaaaaggatgagagtggtagaagttacaacctgatccaggggacccacgacacgctgtaccgcagttggtacctgtcctatacctacggggaccccgagaagggggtgcagtcgtggacgctgctcaccaccccggacgtcacctgcggcgcggagcaagtctactggtcgctgccggacctcatgcaagacccagtcaccttccgctctacccagcaagtcagcaactaccccgtggtcggcgccgagctcatgcccttccgcgccaagagcttttacaacgacctcgccgtctactcccagctcatccgcagctacacctccctcacccacgtcttcaaccgcttccccgacaaccagatcctctgccgcccgcccgcgcccaccatcaccaccgtcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaaatgtctattctcatctcgcccagcaataacaccggctggggtcttactagacccagcaccatgtacggaggagccaagaagcgctcccagcagcaccccgtccgcgtccgcggccacttccgcgctccctggggcgcttacaagcgcgggcggacttccaccgccgtgcgcaccaccgtcgacgacgtcatcgactcggtggtcgccgacgcgcgcaactatacccccgccccctccaccgtggacgcggtcatcgacagcgtggtggccgacgcgcgcgactatgccagacgcaagagccggcggcgacggatcgccaggcgccaccggagcacgcccgccatgcgcgccgcccgggctctgctgcgccgcgccagacgcacgggccgccgggccatgatgcgagccgcgcgccgcgctgccactgcacccacccccgcaggcaggactcgcagacgagcggccgccgccgccgccgcggccatctctagcatgaccagacccaggcgcggaaacgtgtactgggtgcgcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgcaaaatcaagcgggttaaaaaaaaggatgaggtggacgagggggcagtagagtttgtgcgcgagttcgctccgcggcggcgcgtaaattggaaggggcgcagggtgcagcgcgtgttgcggcccggcacggcggtggtgttcacgcccggcgagcggtcctcagtcaggagcaagcgtagctatgacgaggtgtacggcgacgacgacatcctggaccaggcggcggagcgggcgggcgagttcgcctacgggaagcggtcgcgcgaagaggagctgatctcgctgccgctggacgaaagcaaccccacgccgagcctgaagcccgtgaccctgcagcaggtgctgccccaggcggtgctgctgccgagccgcggggtcaagcgcgagggcgagagcatgtacccgaccatgcagatcatggtgcccaagcgccggcgcgtggaggacgtgctggacaccgtgaaaatggatgtggagcccgaggtcaaggtgcgccccatcaagcaggtggcgccgggcctgggcgtgcagaccgtggacattcagatccccaccgacatggatgtcgacaaaaaaccctcgaccagcatcgaggtgcagaccgacccctggctcccagcctccactgctaccgtctccacttctaccgccgccacggctaccgagcctcccaggaggcgaagatggggcgccgccagccggctgatgcccaactacgtggtgcatccttccatcatcccgacgccgggctaccgcggcacccggtactacgccagccgccggcgcccagccagcaaacgccgccgccgcaccgccacccgccgccgtctggcccccgcccgcgtgcgccgcgtgaccacgcgccggggccgctcgctcgttctgcccaccgtgcgctaccaccccagcatcctttaattcgtgtgctgtgatactgttgcagagagatggctctcacttgccgcctgcgcatccccgtcccgaattaccgaggaagatcccgccgcaggagaggcatggcaggcagcggcctgaaccgccgccggcggcgggccatgcgcaggcgcctgagtggcggctttctgcccgcgctcatccccataatcgccgcggccatcggcacgatcccgggcatagcttccgttgcgctgcaggcgtcgcagcgccgttgatgtgcgaataaaagcctctttagactctgacacacctggtcctgtatatttttagaatggaagacatcaattttgcgtccctggctccgcggcacggcacgcggccgttcatgggcacctggaacgagatcggcaccagccagctgaacgggggcgccttcaattggagcagtgtctggagcgggcttaaaaatttcggctcgacgctccggacctatgggaacaaggcctggaatagtagcacggggcagttgctaagggaaaagctcaaagaccagaactttcagcagaaggtggtggacgggctggcctcgggcattaacggggtggtggacatcgcgaaccaggccgtgcagcgcgagataaacagccgcctggacccgcggccgcccacggtggtggagatggaagatgcaactcttccgccgcccaaaggcgagaagcggccgcggcccgacgcggaggagacgatcctgcaggtggacgagccgccctcgtacgaggaggccgtcaaggccggcatgcccaccacgcgcatcatcgcgccgctggccacgggtgtaatgaaacccgccacccttgacctgcctccaccacccgcgcccgctccaccgaaggcagctcccgcggtcgtgcaggcccccccggtggcgaccgccgtgcgccgcgtccccgcccgccgccaggcccagaactggcagagcacgttgcacagtatcgtaggcctgggagtgaaaagtctgaagcgccgccgatgctattgaaagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcagtttgcccgcgccaccgacacgtacttcagcctgggcaacaagtttaggaaccccacggtggccccgacccacgatgtgaccacggaccggtcccagcgtctgacgctgcgcttcgtgcccgtggatcgcgaggacaccacgtactcgtacaaggcgcgcttcactctggccgtgggcgacaaccgggtgctagacatggccagcacttactttgacatccgcggcgtcctggaccgcggtcccagcttcaaaccctactcgggcacagcttacaacagtctggcccccaagggtgcccccaactccagccagtggcttgcaaaagacaccaatgctggcgatcaagcattaaaaacccacacacatggcgtagctgctatggggggaacagatatcacagcaaagggtttgcaaattggtgttgacacgactgaaaacaagaatgagcctatttatgcaaatgaaatataccagccagaacctcaggtaggagaggaaaacttgcaagatgttgaaaacttttatggaggcagagctcttaaaaaagaaaccaaaatgaaaccttgctatggctcgtttgccagacccacaaatgaaaaaggcggtcaagccaaatttttaactgacggcgatggtcagctaactaaaaatcatgatatcacaatgaatttctttgacactcctggaggaacagttggtcaggatactgaacttgaagcagacattgttatgtatgctgagaatgtgcatctggaaactccagacacgcatgtggtgtacaaaccaggaacttctgatgagagttcagaagcaaatttggttcagcagtccatgccaaacaggcccaactacatcggcttcagggacaactttgtgggtctcatgtactataacagcactggcaacatgggtgtgctggctggtcaagcatctcagttgaatgctgtggtcgacttgcaagacagaaacacagagctgtcttaccagctcttgctagattctctgggtgacagaaccagatactttagcatgtggaactctgcagtggacagttatgatcctgatgtcaggattattgaaaatcacggtgtggaagatgaacttccaaactattgcttcccattggatggagctggcactaatgctacctaccaaggtgtaaaagttaaaaatggccaagatggagatgtaaacgcagattgggaaaaagatccaaatcttgcttcacgaaaccaaatatgcaagggtaacatcttcgccatggagatcaacctccaggccaacctgtggaagagttttctgtactcgaatgtggccctgtacctgcccgactcatacaagtacacgccggccaacgtcacgctgcccgccaataccaacacctacgagtacatgaacggccgcgtggtagccccctcgctggtggacgcctacatcaacatcggcgcccggtggtcgctggaccccatggacaacgtcaacccattcaaccaccaccgcaacgcgggcctgcgttaccgctccatgcttctgggcaacggccgctacgtgcccttccacatccaagtgccccaaaagttctttgccatcaagaacctgctcctgctccccggctcctacacctacgagtggaacttccgcaaggatgtcaacatgatcctgcagagttccctcggaaacgacctgcgcgtcgacggcgcctccgtccgcttcgacagcgtcaacctctacgccacattcttccccatggcgcacaacaccgcctccaccctggaagccatgctgcgcaacgacaccaacgaccagtccttcaacgactacctctcggccgccaacatgctctaccccatcccggccaaggccaccaacgtgcccatctccatcccctcgcgcaactgggccgccttccgcggctggagtttcacccggctcaagaccaaagaaactccctccctcggctcgggtttcgatccctactttgtatactcgggttccatcccctacctcgacgggaccttctacctcaaccacaccttcaagaaggtctccatcatgttcgactcctcggtcagctggcccggcaacgaccggctgctcacgccgaacgagttcgagatcaagcgcagtgtcgacggggagggctacaatgtggcccaatgcaacatgaccaaggactggttcctcgtccagatgctctcccactacaacatcggctaccagggcttccacgtgcccgagggctacaaggaccgcatgtactccttcttccgcaacttccagcccatgagcaggcaggtggtcgatgagatcaactacaaggactacaaggccgtcaccctgcccttccagcacaacaactcgggcttcaccggctaccttgcacccaccatgcgtcaggggcagccctaccccgccaacttcccctatcctctcatcggccagacagccgtgccctctgtcacccagaaaaagttcctctgcgacagggtcatgtggcgcatccccttctccagcaacttcatgtccatgggcgccctcaccgacctgggtcagaacatgctctatgccaactcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgcttcccgggcttcctcgccggcgacaagctggcctgcgccattgtcaacacggccggccgcgagaccggaggcgtgcactggctcgccttcggctggaacccgcgctcgcgcacctgctacatgttcgacccatttgggttctcggaccgccggctcaagcagatttacagcttcgagtacgaggctatgttgcgccgaagcgccctggcttcctcgcccgaccgctgtctcagcctcgagcagtccacccagaccgtgcaggggcccgactccgccgcctgcggacttttctgttgcatgttcttgcatgccttcgtgcactggcccgaccgacccatggacgggaaccccaccatgaacttgctgacgggggtgcccaacggcatgctacaatcgccacaggtgctgcccaccctccggcgcaaccaggaggagctctaccgcttcctcgcgcgccactccccttactttcgctcccaccgcgccgccatcgaacacgccaccgcttttgacaaaatgaaacaactgcgtgtatctcaataaacagcacttttattttacatgtactggagtatatgcaagttatttaaaagtcgaaggggttctcgcgctcgtcgttgtgcgccgcgctggggagggccacgttgcggtactggaacttgggctgccacttgaactcggggatcaccagtttgggcactggggtctcggggaaggtctcgctccacatgcgccggctcatctgcagggcgcccagtatgtccggggcggagatcttgaaatcgcagttggggccggtgctctgcgcgcgcgagttgcggtacacggggttgcagcactggaacaccatcagactggggtacttcacactggccagcacgctcttgtcgctgatctgatccttgtccaggtcctcggcgttgctcaggccgaacggggtcatcttgcacagctggcggcccaggaagggcacgctctgaggcttgtggttacactcgcagtgcacgggcatcagcatcatccccgcgccgcgctgcatattcgggtagagggccttgacaaaggccgagatctgcttgaaagcttgctgggccttggccccctcgctgaaaaacaggccgcagctcttcccgctgaactggttattcccgcacccggcatcatgcacgcagcagcgcgcgtcatggctggtcagttgcaccacgctccgtccccagcggttctgggtcaccttggccttgctaggctgctccttcaacgcgcgctggccgttctcgctggtcacatccatctccaccacgtggtccttgtggatcatcaccgtcccgtgcaaacacttgagctggccttccacctcggtgcagccgtgatcccacagggcgcagccggtgcactcccaattcttgtgtgcgatcccgctgtggctgaagatgtaaccttgcaacaggcgacccatgacggtgctaaatgatttactggtgctgaaggtcagttgcagaccgcgggcctcctcgttcatccaggtctggcacatcttttggaagatctcggtctgctcgggcatgagcttgtaagcatcgcgcaggccgctgtcgacgcggtagcgttccataagcacgttcatggtatccatgcccttctcccaggacgagaccagaggcagactcagggggttgcgcacgttcagaataccgggggtcgcgggctcgacgatgcgttttccgtccttgccttccttcaacagaaccggcggctggctgaatcccactcccacgatcacggcatcttcctggggcatctcttcgtcggggtctaccttggtcacatgcttggtctttctggcttgcttcttttttggagggctgtccacggggaccacgtcctcctcggaagacccggagcccacccgctgatactttcggcgcttggtgggcagaggaggtggaggcgaggggctcctctcctgctccggcggatagcgcgccgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaagagccggctcgtctagaacccccacaggatgaacaggagcacgagcaagacgcaggccaggaggagaccgacgctgggctcgagcatggctacctgggaggagaggaggatgtgctgctgaaacacttgcagcgccagtccctcatcctccgggacgccctggccgaccggagcgaaacccccctcagcgtcgaggagctgtgtcgggcctacgagctcaacctcttctcgccgcgcgtgccccccaaacgccagcccaacggcacctgcgagcccaacccgcgtctcaacttctatcccgttttcgcggtccccgaggcccttgccacctatcacatttttttcaagaaccaaaagatccccgtctcctgccgcgccaaccgcacccgcgccgacgcgctcctcgctctggggcccggcgcgcgcatacctgatatcgcttccctggaagaggtgcccaagatcttcgaagggctcggtcgggacgagacgcgcgcggcgaacgctctgaaagaaacagcagaggaagagggtcacactagcgccctggtagagttggaaggcgacaacgccaggctggccgtgctcaagcgcagcgtcgagctcacccactttgcctaccccgccgtcaacctcccgcccaaggtcatgcgtcacatcatggatcagctcatcatgccccacatcgaagccctcgatgaaagtcaggagcagcgccccgaggacgcccgacccgtggtcagcgacgagatgctcgcgcgctggctcgggacccgcgagccccaggctttggaacagcggcgcaagctcatgctggccgtggtcctggtcaccctcgagctcgaatgcatgcgccgcttcttcagcgaccccgagaccctgcgcaaagtcgaggagaccctgcactacactttcagacacggtttcgtcaggcaggcctgcaagatttccaacgtggagctgaccaacctggtctcctgcctggggatcctgcatgagaaccgcctgggacagaccgtactccactctaccctgaagggcgaggcgcggagggactatgtccgcgactgcgtctttctctttctctgccacacatggcaagcagccatgggcgtgtggcagcagtgtctcgaggacgagaacctgaaggagctggacaagcttcttgctagaaaccttaaaaagctttggacgggcttcgacgagcgcaccgtcgcctcggacctggccgagatcgtcttccccgagcgcctgaggcagacgctgaaaggcgggctgcccgacttcatgagccagagcatgttgcaaaactaccgcactttcattctcgagcgatcggggatgctgcccgccacctgcaacgctttcccctccgactttgtcccgctgagctaccgcgagtgtcccccgccgctgtggagccactgctacctcttgcagctggccaactacatcgcctaccactcggacgtgatcgaggacgtgagcggcgaggggctgctcgagtgccactgccgctgcaacctgtgctccccgcaccgctccctggtctgcaacccccagctccttagcgagacccaggtcatcggtaccttcgagctgcaaggtccgcaggagtccaccgctccgctgaaactcacgccggggttgtggacttccgcgtacctgcgcaaatttgtacccgaggactaccacgcccatgagataaagttcttcgaggaccaatcgcggccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacacgggtctcccccagcatgccgaggaagaagcaggagccgctagtggaggagatggaagaagaatgggacagccaggcagaggaggacgaatgggaggaggagacagaggaggaagaattggaagaggtggaagaggagcaggcaacagagcagcccgtcgccgcaccatccgcgccggcagccccggcggtcacggatacaacctccgcagctccggccaagcctcctcgtagatgggatcgagtgaagggcgacggtaagcacgagcggcagggctaccgatcatggagggcccacaaagccgcgatcatcgcctgcttgcaagactgcggggggaacatcgctttcgcccgccgctacctgctcttccaccgcggggtgaacatcccccgcaacgtgttgcattactaccgtcaccttcacagctaagaaaaagcaagtaagagaagtcgccggaggaggcctgaggatcgcggcgaacgagcccttgaccaccagggagctgaggaaccggatcttccccactctttatgccatttttcagcagagtcgaggtcagcagcaagagctcaaagtaaaaaaccggtctctgcgctcgctcacccgcagttgcttgtaccacaaaaacgaagatcagctgcagcgcactctcgaagacgccgaggctctgttccacaagtactgcgcgctcactcttaaagactaaggcgcgcccacccggaaaaaaggcgggaattacctcatcgccaccatgagcaaggagattcccaccccttacatgtggagctatcagccccagatgggcctggccgcgggcgcctcccaagactactccacacgcatgaactggctcagtgccggcccctcgatgatatcacgggtcaacggggtccgcagtcatcgaaaccagatattgttggagcaggcggcggtcacctccacgcccagggcaaagctcaacccgcgtaattggccctccaccctggtgtatcaggaaatccccgggccgactaccgtactacttccgcgtgacgcactggccgaagtccgcatgactaactcaggtgtccagctggccggcggcgcttcccggtgcccgctccgcccacaatcgggtataaaaaccctggtgatccgaggcagaggcacacagctcaacgacgagttggtgagctcttcgatcggtctgcgaccggacggagtgttccaactagccggagccgggagatcgtccttcactcccaaccaggcctacctgaccttgcagagcagctcttcggagcctcgctcgggaggcatcggaaccctccagttcgtggaggagtttgtgccctcggtctacttcaaccccttctcgggatcgccaggcctctacccggacgagttcataccgaacttcgacgcagtgagagaagcggtggacggctacgactgaatgtcccatggtgactctgctgagctcgctcggttgaggcatctggaccactgccgccgcctgcgctgcttcgcccgggagagctgcggactcatctactttgagtttcccgaggagcaccccaacggtcctgcacacggagtgcggatcaccgtagagggcaccaccgagtctcacctggtcaggttcttcacccagcaacccttcctggtcgagcgggaccggggcgccaccacctacaccgtctactgcatctgtccgaccccgaagttgcatgagaatttttgctgtactctttgtggtgagtttaataaaagctaaactcttgcaatactctggaccttgtcgtcatcaactcaacgagaccgtctacctcaccaaccagactgaggtaaaactcacctgcagaccacacaagacctatatcatctggttcttcgagaacacctcatttgcagtctcaaacactcactgcaacgacggtgttgaacttccaaacaacctttccagtggactgagttacgatacacatagagctaagctcgtcctctacaatcctttcgtagagggaacctaccactgccagagcggaccttgcttccacagttttactttggtgaacgttaccggcagcagcacagccgctccagaacctaaccttccttctgatactatcaaacctcgtttcggaggtgagctaaggcttcccccttctgaggagggggttagcccatacgaagtggtcgggtatttgattttaggggtggtcctgggtgggtgcatagcggtgctagctcagctgccttgctgggtagaaatcaaaatctttatatgctgggtcagacattgtggggaggaactatgaaggggctcttgctgattatcctttccctggtggggggtgtgctgtcatgccacgaacagccacgatgtaacatcaccacaggcaatgagaggagtgtcatatgcacagtagtcatcaaatgcgagcatgaatgccctctcaacatcacattcaaaaaccgtaccatggggaatgcatgggtgggcgactgggaaccaggagatgagcagaactacacggtcactgtccatggtagcgatggaaatcacactttcggtttcaaattcatttttgaagtcatgtgtgatatcacactgcatgtggctagacttcatggcttgtggccccctaccaaggaaaacatggttgggttttctttggcttttgtgatcatggcctgctttatgtcaggtctgctggtaggagctctagtgtggttcctgaaacgcaagcccaggtatggaaatgaggagaaggaaaaattgctataaattctttttcttttcacagcaccatgaatactttgaccagtgtcgtgctgctctctcttcttgtagcttttagtcaggcaggaattattaacttaaatgtatcatggggaatgaatctaactttagtgggaccctcagacctgccagttacatggtatgatggaaagggaatgcagttttgtgatggaaatacaattaagaacccacaaatcaagcatagctgtaatcaacagaatctaactttacttaatgctgacaagtctcatgaaagaacttacctaggttacagacatgacagtaagggaaaagtagactataaggttacagtcataccacctcctccagccactcgcaagcctttgtcagagcctcattatgttactgtgactatgggcgataacataactttagtgggaccctcagacctgccagttacatggtatgatggagaaggaaataaattctgcgatggagaaaaagttgaacatgcagaatttaatcatacatgtaacatccagaacctgacactgctctttgtcaacttaacgcataatggagcatacattggttataacaaagacggttctgatagagaattatatgaggtgtcagtcaaaaccttgtttcagaacggggctggacaaagtaaggttgaacaaggtaataaagggaaacctaatactgctcaaagtggtggtaaaaaaaccaaaacagaacatagaaaccagagtccaaaaagaaaatcaacaaataaccttcagccaacacaattgtatgttaggccttttactaatgttagtttaactggacctccaaatggcaaggttacttggtatgatggcgaacttaatgatccatgtgaacaaaagtacaaactcagaactttttgcaatcagcaaaatctaactttaattaatgtaagcagcacttatgatggcatctattatggcactgatgaaaaagataaggcaaatcgttacagaataaaagtaaatactacaaatcacaaaactgttaaaattaagccacataccagagaacctcctgctgtacaagaaaaacagtttgaattacaagatgcagaaactgatgaaaacgaatcaaaaattccctcagctactgtggcaatcgtggtgggagtgattgcgggctttgtaactctgatcattgtcttcatatgctacatctgctgccgcaagcgtcccaggtcatacaatcatatggtagacccactactcagcttctcttactgaaactcagtcactctcatttcagaaccatgaaggctttcacagcttgcgttctgattagcatagtcacacttagttcagctgcaatgattaatgttaatgtcactagaggtggtaaaattacattgaatgggacttatccacaaactacatggacaagatatcataaagatggatggaaaaatatctgtgaatggaatgttactgcatataaatgcttcaataatggaagcattactattactgccactgccaacattacttctggcacatacaaagctgaaagctataaaaatgaaatcaaaaaactaacctataaaaacaacaaaaccacatttgaagattctggaaattatgaacatcaaaaattatctttttatatgttgacaataattgaactgcctacaactaaggctcccaccacaaccagtacaactattaagaccactactcacactacagtgcaaaatactactttattgattgggtttttactgagagagaatgaaagtactactgaacagacagaggctacctcaagtgccttcagcagcactgcaaatttaacttcgcttgcttggactaatgaaaccggagtatcattgatgcatggccagccttactcaggtttggatattcaaattacttttctggttgtctgtgggatctttattcttgtggttcttctgtactttgtctgctgcaaagccagagagaaatctaggaggcccatctacaggccagtgattggggaacctcagccactccaagtggatggaggcttaaggaatcttctcttctcttttacagtatggtgatcagccatgattcctaggttcttcctatttaacatcctcttttgtctcttcaacatctgtgctgccttcgcggccgtctcgcacgcctcgcccgactgtctagggcctttccccacctacctcctctttgccctgctcacctgcacctgcgtctgcagcattgtctgcgtggtcatcaccttcctgcagctcatcgactggtgctgcgcgcgctataattatctccaccacagtcccgaatacagggacgagaacgtagccagaatcttaaggctcatctgaccatgcagactctgctcatgctgctatccctcctatcccctgccctcgccacttctgctgactctaaatgcaaattcgcggagatatggaatttcttagattgctatcaggagaaaattgatatgccctcctattacttggtgattgtgggaatagtcatggtctgctcctgcactttctttgccatcatgatctacccctgttttgatctcggctggaactctgttgaggcattcacatacacactagaaagcagttcactagcctccacgccaccgcccacaccgcctccccgcagaaatcagttcccactgattcagtacttagaagagccccctccccggcccccttccactgttagctactttcacataaccggcggcgatgactgaccaccacctggacctcgagatggacggccaggcctccgagcagcgcatcctgcaactgcgcgtccgtcagcagcaggagcgggccgccaaggagctcctcgatgccatcaacatccaccagtgcaagaagggcatcttctgccttgtcaaacaggcaaagatcacctacgagctcgtgtccggcggcaagcagcatcgcctcacctatgagctgccccagcagaagcagaagttcacctgcatggtgggcgtcaaccccatagtcatcacccagcagtcgggcgagaccaacggctgcatccactgctcctgcgaaagccccgagtgcatatactccctcctcaagaccctttgcggactccgcgacctcctccccatgaactgatgttgattaaaagcacgaaaaccaatcagacccttcccccatttccccattcccaattactcataaaataaatcattggaattaatcattcaataaaaatcacttacttgaaatctgaaagtatgtctctggtgtagttgttcagcagcacctcgttaccctcctcccagctctggtattccagtccccggcgggcggcgaacttcctccacaccttgaaagggatgtcaaattcctggtccacaattttcattgtcttccctctcagatgtcaaagaggctccgggtggaagatgacttcaaccccgtctacccctatggctacgcgcggaatcagaatatccccttcctcactcccccctttgtctcctccgatggattccaaaacttcccccctggggtcctgtcactcaaactggctgacccaatagccatcgtcaatgggaatgtctcactcaaagtgggagggggtctcactttgcaagatggaactggaaaactaacagtcaatgctgatccacctttgcaacttacaaacaacaaattagggattgctttggacgctccatttgatgttatagacaataaactcacattgttagcgggccatggcttgtctattataacaaaagaaacatcaacactgcctggcttgattaatactcttgtagtattaactggaaagggtattggaacagaatcaacagataatggcggaagcgtatgtgttagagttggagaaggtggcggcttatcatttaataatgatggagacttggtagcatttaataaaaaagaagataagcgcaccctatggacaactccagacacatctccaaattgcaagattgatcaagataaggactctaagttaactctggtccttacaaagtgtggaagtcaaatattggctaatgtgtcattaattgtcgtagctggtaagtacaaaattatcaataacaatactcaaccagctctcaaaggatttaccattaaattattgtttgatgaaaatggagtacttatggaatcttcaaatcttggtaaatcatattggaactttagaaatgaaaattcaattatgtcaacagcttatgaaaaagctattggattcatgcctaatttggtagcctatccaaaacctaccgctggctctaaaaaatatgcaagagatatagtttatggaaacatctaccttggtggaaagccagatcaaccagtaaccattaaaactacctttaatcaggaaactggatgtgaatattctatcacatttgattttagttgggccaagacttatgtaaatgttgaatttgaaacaacctcttttaccttttcctatatcgcccaagaatgaaagaccaataaacgtgtttttcatttcaaaattttcatgtatctttattgatttttacaccagcacgggtagtcagtctcccaccaccagcccatttcacagtgtacactgttctctcagcacgggtggccttaaatagggaaatgttctcattagtgcgggaactggacttggggtctataatccacacagtttcctggcgagccaaacgggggtcggtgattgagatgaagccgtcctctgaaaagtcatccaagcgagcctcacagtccaaggtcacagtctggtggaatgagaagaacgcacagattcatactcggaaaacaggatgggtctgtgcctctccatcagcgccctcagcagtctctgccgccggggctcggtgcggctgctgcagattggatcgggatcgcaagtctctctgactataatccccacagccttcagcatcagtctcctggtgcgtcgggcacagcaccgcatcctgatctctgccatgttctcacagtaagtgcagcacataatcaccatgttattcagcagcccataattcagggcgctccagccaaagctcatgttggggatgatggaacccacgtgaccatcgtaccagatgcggcagtatatcaggtgcctgcccctcataaacacactgcccatatacatgatctctttgggcatgtttctgttcacaatctgacggtaccaggggaagcgctggttgaacatgcacccgtaaatgactctcctgaaccacacggccagcagggtgcctcccgcccgacactgcagggagcccggggatgaacagtggcaatgcaggatccagcgctcgtacccgctcaccatctgagctctcaccaagtccagggtagcagggcacaggcacactgacatacatctttttaaaatttttatttcctctggggtcaggatcatatcccaggggactggaaactcttggagcagggtaaagccagcagcacatggtaatccacggacagaacttacattatgataatctgcatgatcacaatcgggcaacaggggatgttgttcagtcagtgaagccctggtttcctcatcagatcgtggtaaacgggccctgcgatatggatgatggcggagcgagctggattgaatctcggtttgcattgtagtggattctcttgcgtaccttgtcgtacttctgccagcagaaatgggcccttgaacagcagatacccctcctgcggccgtcctttcgctgctgccgctcagtcatccaactgaagtacatccattctcgaagattctggagaagttcctctgcatctgatgaaataaaaaacccgtccatgcgaattcccctcatcacatcagccaggactctgtaggccatccccatccagttaatgctgccttgtctatcattcagagggggcggtggcaggattggaagaaccatttttattccaaacggtctcgaaggacgataaagtgcaagtcacgcaggtgacagcgttcccctccgctgtgctggtggaaacagacagccaggtcaaaacccactctattttcaaggtgctcgaccgtggcttcgagcagtggctctacgcgtacatccagcataagaatcacattaaaggctggccctccatcgatttcatcaatcatcaggttacattcctgcaccatccccaggtaattctcatttttccagccttgaattatctctacaaattgttggtgtaagtccactccgcacatgtggaaaagctcccacagtgccccctccactttcataatcaggcagaccttcataatagaaacagatcctgctgctccaccacctgcagcgtgttcaaaacaacaagattcaataaggttctgccctccgccctgagctcgcgcctcaatgtcagctgcaaaaagtcacttaagtcctgggccactacagctgacaattcagagccagggctaagcgtgggactggcaagcgtaagggaaaactttaatgctccaaagctagcacccaaaaactgcatgctggaataagctctctttgtgtctccggtgatgccttccaaaatgtgagtgataaagcgtggtagtttttctttaatcatttgcgtaatagaaaagtcctctaaataagtcactaggaccccagggaccacaatgtggtagcttacaccgcgtcgctgaagcatggttagtagagatgagagtctgaaaaacagaaagcatgcactaaactaaggtggctatttttactgaaggaaaaatcactctctccagcaacagggtacccactgggtggcccttgcggacatacaaaaatcggtccgtgtgattaaaaagcagcacagtaagttcctgtcttcttccggcaaaaatcacatcggactgggttagtatgtccctggcatggtagtcattcaaggccataaatctgccctgatatccagtaggaaccagcacactcacttttaggtgaagcaataccaccccatgcggaggaatgtggaaagattcagggcaaaagaaggtatatctattgctagtcccttcctggacgggagcgatccctccaggactatctatgaaagcatacagagattcagccatagctcagcccgcttaccagtagacagagagcacagcagtacaagcgccaacagcagcgactgactacccactaacccagctccctatttaaaggcaccttacactgacgtaatgaccaaaggtctaaaaaccccgccaaaaaaacacacacgccctgggtgttttttcgcgaaaacacttccgcgttctcacttcctcgtatcgatttcgtgactcaacttccgggttcccacgttacgtcacttctgcccttacatgtaactcagtcgtagggcgccatgttgcccacgtccaaaatggtttccatgtccagccacgcctccgcggcgaccgttagccgtgcgtcgtgacgtcatttgcatcgtcttctctcgtccaatcagcgttggctccgccccgaaaccgttaaaattcaaaagctcatttgcatattaacttttgtttactttgtggggtatattatatagatag

SEQ ID NO: 141 - DNA, 34794 bp, Human adenovirus type 11; identical to SEQ ID NO: 138

SEQ ID NO: 142 - DNA, 34125 bp, Human adenovirus A
cctatctaataatataccttatactggactagtgccaatattaaaatgaagtgggcgtagtgtgtaatttgattgggtggaggtgtggctttggcgtgcttgtaagtttgggcggatgaggaagtggggcgcggcgtgggagccgggcgcgccggatgtgacgttttagacgccattttacacggaaatgatgttttttgggcgttgtttgtgcaaattttgtgttttaggcgcgaaaactgaaatgcggaagtgaaaattgatgacggcaattttattataggcgcggaatatttaccgagggcagagtgaactctgagcctctacgtgtgggtttcgatacgtgagcgacggggaaactccacgttggcgctcaaagggcgcgtttattgttctgtcagctgatcgtttgggtatttaatgccgccgtgttcgtcaagaggccactcttgagtgccagcgagaagagttttctctgccagctcattttcacggcgccattatgagaactgaaatgactcccttggtcctgtcgtatcaggaagctgacgacatattggagcatttggtggacaacttttttaacgaggtacccagtgatgatgatctttatgttccgtctctttacgaactgtatgatcttgatgtggagtctgccggtgaagataataatgaacaggcggtgaatgagttttttcccgaatcgcttattttagctgccagtgaggggttgtttttaccggagcctcctgtactttctcctgtctgtgagcctattgggggcgaatgtatgccacaactgcaccctgaagatatggatttattgtgctacgagatgggctttccctgtagcgattcggaagacgagcaagacgagaacggaatggcgcatgtttctgcatccgcagctgctgctgccgctgatagggaacgtgaggagtttcagttagaccatccagagttgcccggacacaattgtaagtcctgtgagcaccaccggaatagtactggaaatactgacttaatgtgctctttgtgctatctgcgagcctacaacatgttcatttacagtaagtgtgctatgggaggtgggaggtgatttttttttcttaagcagtgaaaaataatattttgttgtttttaggtcctgtttccgataatgagcctgaacctaatagcactttggatggcgatgagcgaccctcacccccgaaactaggaagtgcggttccagaaggagtaataaaacctgtgcctcagcgggtgactgggaggcgtagatgtgctgtggaaagcattttggatttgattcaagaggaagaaagagaacaaacagtgcctgttgatctgtcagtgaaacgccctagatgtaattaatggactttgagcacctgggcaataaaataggggtaatgtggtttttgtgagtcatgtataataaaactggtttcggttgaagtgtcttgttaatgtttgtttgggcgtggttaaacagggatataaagctgggttggtgttgctttgaatagttcatcttagtaatggagttggaaactgtgctgcaaagttttcagagcgttcgccagctcttgcagtatacctctaaaaacacttcaggtttttggaggtatctgtttggctctaccttaagcaaggtggtaaatagggtgaaagaagactatagagaggaatttgaaaacatattggccgactgtccagggcttttggcttcactagacctttgttaccacttggtgtttcaggaaaaagtggtcagatccttagatttttcatctgtgggacgaacggttgcttctattgcttttttggcaaccatattggataaatggagcgagaaatcccacctgagttgggattacatgctggattacatgtcaatgcagctgtggagggcatggctgaagaggagggtttgcatttactcgctggcgcggcctttgaccatgccgccgctgccgacgttgcaagaggagaaggaggaggagcggaaccctgcggtggtggagaagtaaacatggaacaacaggtgcaagaaggccatgtacttgactctggcgaagggcctagttgcgcagatgatagagataagcaggaaaaaaaagaaagtttaaaggaagctgctgttcttagtaggctaactgttaatctgatgtcccgcccgcgtttggaaactgtatattggcaggagttgcaggatgaatttcagcggggtgatatgcatttacagtacaaatacagttttgaacaattaaaaacccactggttagagccatgggaggatatggagtgtgctattaaagcttttgctaaattggccttacgtcctgattgtagctacagaattactaaaacagtaaccattacttcatgcgcctatattataggtaacggggcaatagttgaggtagatacaagcgacagagttgcttttagatgtcgaatgcagggtatgggcccaggggtggtgggtttggatggaattacatttataaatgttaggtttgctggagataagtttaaaggcattatgttcgaagctaatacctgtcttgtcttgcatggtgtttactttcttaactttagtaacatttgtgtagagtcttggaataaggtttctgctaggggctgtactttttatggatgttggaagggtttggtgggtagaccaaaaagtaaactgtctgtaaaaaagtgtttgtttgaaaaatgtgtacttgctttaattgtagagggggatgcacatattaggcataatgcagcttcagaaaatgcctgttttgtattattgaagggaatggctattttaaagcataatatggtttgtggggtgtctgatcaaactatgcgacgttttgttacctgtgctgatggaaattgtcataccttaaaaactgttcatattgtgagccacagtagacattgttggcctgtatgtgatcataacatgtttatgcgctgtaccatacatttaggcttaaggcggggtatgtttagaccttcccaatgtaacttcagccactcaaacattatgctggaacctgaagtgttttctagagtgtgtttaaatggggtatttgatttatctgtggaattatgtaaggttataagatataatgatgatactcgacatcgttgccgacagtgtgagtgtggtagcagtcatctagaacttcgtcccattgtgctaaatgtaactgaggagctgagaagtgaccaccttaccctgtcttgcctgcggactgactatgagtcaagtgatgaagacgacaactgaggtaagtgggtggagctaggtgggattataaaaggctggaagtcaactaaaaattgtttttgttcttttaacagcacgatgaacggaactactcagaacaacgctgcgctttttgatggaggggtttttagcccttatttgacttccaggttaccatattgggccggagtacgtcagaatgtggtaggatctacagtggacggtcgacctgtggcacctgcaaattcatcaacattaacctatgcaactattggaccctcgcctttggataccgccgccgccgctgcagcttccgcggccgcttctacggctcgcagtatggcagctgatttcagcttctacaatcacttggcttcgaatgctgtgacacgcaccgcagttcgagaggacattctgactgttatgcttgccaagcttgaaactctaactgctcagctggaagagctatcgcaaaaggttgaggaattagctgatgctactacccataccccagcccaacctgtaacccaataaagaaaaaacttaaattgagatggtgttatgaatctttattgatacttgttttttctgacatggtaagctcttgaccaccgttccctatcattaagaacacggtgaatgtgttccagtattttgtaaagatgagcctgtatattaaggtacattggcattaggccatctttgggatgaaggtaggaccattgaagggcttcatgttccgggttagtgttgtagataatccagtcatagcaacaacgctgggcatggtgattaaatatatcttttaacaacaagctaattgctaatggaagacctttagtataggtattgataaaacggttaagctgggtgggatgcatccgaggtgacatgatatgaagttttgattgtattttgagattggcaatgttacctgccaaatctcttcttggattcatattgtggagaaccacgaaaacggtgtagccagtacacttgggaaatttgtcatggagtttagaaggaaaggcatggaaaaacttggaaacgcctttgtgacttcccaaattttccatacactcatccattattatggcaattggaccgcgagcagcggcttgagcaaaaatgttttctggatcagaaacatcatagttgtggtctagagttaggtcatcgtaggacaacttaacaaatttaggacacagcgttccagattgtggaataatagttccctctggtcctgggacataatttccctcacaaatttgcatttcccaagatttaatttcagatgggggaatcatgtccacttgcggaacaataaaaaaaacagtttctggagcaggtgtaaccagctgggcagaaagcaaattacgcaacaactgagacttcccacagccagtgggtccataaattaccccaattacaggttgcaagtgatagtttaacgaggtgcagctgccgtcttcgtggagaagcggagccacttcattcatcatttgtcggacgcggatgttttgcttggccagttcccctaacagacgctctccgcctaaggaaagtaactcttgtaaagatttgaaatttttaagtggctttaggccatcggccataggcatgtggtccagggtttgcttcagcagttgcaagcgatcccatagctcagttatattttctatgccatctcgatccagcaaacttcctcgttgcgggggtttggctggctgttgctgtaaggaacgaggcggtgagcatccaaatggacgagggttttgtccttccagggacgtaatgtgcgcgtcagggttgtttcggtcacggtgaatggatgcgctcctggttgagcgctggccagtgtgcgctttaaactgaggcggctggtgctgaagcgcgtgtcttctccctgtgcttcggcaaggtagcattttaacataagatcataagacaaagcctctgtagcgtggcctttagcccgtatttttcctttggaggtgctcccgcagtgaggacactgaaggcatttaagggcgtacagttttggagccaaaaaaacagattctggagaataagcatctgcgccacaataactacaaacagtttcacattcaactgaccaggtcagctcaggacatgatggatcaaaaacaagtttccctccgtactttttgatgcgtttcttaccttgcgactccataaggcggcgtcctttctctgtgacaaaaagactgtcagtgtctccgtatacagatttaaggggtctatccttcagtggtattccgcggtcctcctcgtacaggaattctgaccactctgacacaaaagctctagtccaagcaagtacaaaggaagccacatgggaagggtaccgatcgttgttaattaaagggttagaactttctaaggtgtgtaaacacatgtctccttcttcagcgtccatgaatgtgattggtttgtaggtgtaagtcacgtgttcacaattttctggtggtgggctataaaaaggggcgggtccttggtcttcatcgctttcttctgcttcgctgtttacgagcgccaactggttgggtgagtacacgcgctcaaaggcaggcattacctctgtactcaacgtgtcagtttctataaacgatgaggatttgatgtttaatcgccccgctgcaatttctttcattaggctttcttccatttgatcagaaaaaactatttttttgttatctagtttggtagcaaaagatccgtacaaggcattggaaagcagcttggctatagatcttagggtttgatttttgtccctatcggcccgttcttttgcggcaatattgagttgcacatattcgcgtgccaggcatttccaggtggggaaaatggtggtgcgctcgtcagatagcaagcgtaagcgccacccgcgattatgcagtgtaaccagatctacgctggtaactacttcaccgcgcaagctttcattggtccaggctaaacgaccgccttttctagaacaaaaaggaggaagaacatccaactgattttcatctggggggtcggcatctatagtaaaaatgccaggacaaagatttttgtcaaaataatcaattttgcaagtgtaattttccagcgccacctgccattgccgcacggccaatgcccgctcataggggttaaggggaggaccccaaggcatggggtgtgtgagggccgatgcatacatgccgcaaatatcatatacatatatgggctcttttagtactcctatgtaagtaggatagcacctgccgccacgaatgctggcgcgaacgtagtcatatagctcatgtgaaggcgccaggatgttgggcccaagatgtgtgcgctgtggtttttcggcgcggtacaaaatttgtctgaaaattgcatgagagttagaggaaatggtaggacgctgaaacacattaaaatgtgccgcgtcaagacccactgcgtcagtaacaaactgggcgtatgagctacgcagtttttctaccaatgaggcagtcacaagtacatccagggcacaatagtttaatgtttccccgataagattgtaatttttttctcctttttttttccatagttcttgatttaggaggtattcctccttatccttccagtactcctccaggggaaacccatttgcatctgcacggtaagaaccaagcatataaaactgatttaccgccttgtacggacaacatcctttttctacaggcagggcatacgcttgtgcagcctttcttaaagatgtatgagtaagagcaaaggtatctctgaccattacttttaaatactggtatttaaaatcttggtcgtcacaccctccgtgttcccacagtaggaagttagttcgctttttgtagtggggattgggaagggcaaaagtaatatcattaaataatattttgccagctcttggaataaaatttctagaaattttaaagggtccagggacgtccaagcggttattgattacctgagcggcaagaacaatttcatcaaatccattaatattgtgtcctactatatacaactctacaaatcttggctcacccttaattgcaggggctcttttaagatcttcgtaggaaagatcttcaagcgcgactagtccgttttcttcttgagcccattgagacaagtgtggatttttttgtaaaaaagtcatccaaagatcagtagctaaggaggtttgtaagcggtttctataggtacgaaactgttgaccgaccttcattttttctggggttaagcagtagaaagtagtagagtctttttcccattggtcccatccaagttctaatgcaagttgtaaggcatgtttgacaagattgtcatccccagacagtttcatcaccagcataaatgggacaagttgctttccaaatgcccccatccaggtgtaggtttctacatcataggtaataaaaaggcgctcagtgcgaggatgcgaaccgattgggaaaaagtggatctcctgccaccagttggaagaatggctgttgatgtgatgaaagtagaaatctcgtcggcggacagagcattcatgctgatgtttgtaaaagcgtgcgcagtgttcgcatcgttgcacgggctgtatctgttgaatgaggtgtacctggcggcctcgcaccagaaagcagatgggaaaatcaataccacttggcagctgccgttcgtcctcttcctcttctgctgcattgccactaccgtttggatcctcgaaagcgagaacggagagggtgacggtgcccctcgacctgcatgtccagatttcagcacgagaggggcggaaacgggaaatcagggcgtacagcctggagctgtccatggtatcagtcagagagaaaagcatgtccgcggggacagcgcgcaagttgacttcgcacaggcgggtaagagcaggctggaggtgcaggtaatacttaatttctagaggcgtgccgttggcagagtctattgcgtgaagtattccatgagcccggggactaaccacggttccacggtgcacttttccaatgcgcctgcttaaaatcggcggcgcggacgagctcccggaggaagcggcggttcgggtcctgcgggaagcgggggaagcggtatgtcggcctgacgctctggcaggggaaggtgttgagcccgaagttgactggcatgggcgactacccggcgattgatatcttgaatctgtcggcgttgtgtaaacactaccggccctgttgttttgaacctgaaagaaagttcaacagaatcaatctcagtgtcatttactgcagcctgtcttaaaatctcctgaacgtcgcctgagttatcttggtaggcaatttctgccattaattgatcaatttcttcctcctggaggtctccatgtcccgcacgttcaatagtggctgcaaggtcattagatatccgactcataagctgtgaaaatgcgtttagtccaatttcgttccagactcggctgtatactacccctccttcgctgtcccgagcgcgcataaccacttgcgccaagttgagttccacgagccgtgcgaacacgccgtagttgcgcaagcgctgaaacaggtagtttaaggtggtggcaacgtgttctgagacgaagaaatacagaatccaccgacgaagcgtcagctcgttgatgtcacctaaggcttcaagacgttccatggcttcgtaaaagtctactgcaaaattgaaaaactgggagttgcgagctgccaccgtcaattcttcttccaacagacgaataagctcggccaccgtctcgcgcacttcttgctgaaatgcgcccggaactatttcttgttcttcctcttctacctccattatttcttcctcgaccacaggtggtgggggttgtcttcttcgacgccggcgaacgggcagcctgtctacaaatctttcaatcatttcgccgcgacggcggcgcatagtttcggttactgctcgaccgttttcacgtggtcgtaactcaaaaactccacctctaagttctgtttcatgtaaaatgggaaatgaggcgttgcgaggggcgttaggtagggatacagcgctgattatgcattttattatttgctgcgtaggaactccgcgcaaggagctaagcgtctgcatatccaccgggtcggagaacctttcaagaaaggcatctagccagtcacagtcacaaggtaggctaagttttgtttcttctaaagtaccaggaagctgagcaatgctactaataatgtaattgaagtaagctgttttaagcccacgaatggttttaagaagcaccacatctttgggtccggcttgttgaattcgcaggcggtctgccattccccacacgtcactttgacatcgtccaagatctttgtagtagtcttgcattaacctttccacctctacctcgcggtttccgcgatcagccatgtgcgtgcttccgtagccttgcagcggttgtaataaagctaaatctgccactacccgttccgcaagcactgcctgttgaatttgggtaagggtggttgcaaagtcatccacatctacaaagcggtgataagctcctgcattaatggtgtagctgcagtttgtcattactgaccaattaacagtttgcgtgcctggctgtacagtttctgtgtatcgcaagcgtgagtaagcccgagagtcaaaaacatagtcattgcaggtgcgcactaggtattgatagcccacaaggaaatgaggaggaggttcgcgatacaacggccagccaagcgtagccgcagcacctggagcgagatcttccaacatgaggcggtggtattcatatatgtatctggacatccatgtgatgccggcagcggtagttgttgctcgcataaattcgcgggctcggttccaaatattgcgcaggggtaaaaagcgttcaatagttgccacgctttgaccggtcaggcgtgcgcagtcttgaatgctctggacatggaaaaaatgaaagttggtaagcgactcccttccgtggtttggtggaaaagtcacaagggtaccatagcgaggaaccccggttcgaaaccggcaggatccgctatgagcacaagtgaggcgcttgcgcgttgaacccggccaaggacccccagacacggagaggagtctttttttatttattttttcttagatgcatcctgtcctgcgacaaatgcgacctcagcccagggcaaccacggcctcagcagcggtggcgctttcgggctctggcgaacaggaagagcctcaatgtcctacattggagttggaagaaggagaaggcatagcccgattgggcgcccactctcctgagcgtcacccaagggtgcagctcgcccgggacagtcgcgtggcatttgtgcctcgtcagaacatgtttcgcgacaacagcggggaggaagctgaggaaatgcgagactgcaggtttagggccggtcgcgagctgcgccgcggatttaatcgcgagcgactgctgcgtgaggaggactttgagccagatgaacattcggggattagttctgcacgggcccatgtatcagcagccaacttagtaacagcatatgaacaaacggttacagaggaacgtaactttcaaaaaagctttaataaccatgtgcgcacactaatagcgcgagaagaagtagccattggtttaatgcatctttgggactttgtagaagcttatgtacataatccagcaagtaaacccctaactgcccagctgttcttaatagttcaacatagtagagacaatgaaacttttagggatgcaatgcttaacatagctgaaccccagggtcggtggttactcgatttaattaacattctgcagagcattgtggttcaggaacgcagtcttagtttggcagacaaggtggccgccattaattactccatgttaagtttgggaaagttttatgctcgtaaaatctacaaaagtccgtatgttcccattgacaaggaagtgaagatagacagcttttatatgcgcatggctttaaaggtactaacattaagcgacgatcttggagtgtaccgcaatgaccgaatccacaaagcagtaagcgccagtcgccgcagagagctaagcgacaaagagcttatgcatagcttacaaagggcgctgacgggagcaggaacagaggacgagtcgttctttgatatgggcgcagacctacggtggcagccaagcgctcgcgctttggaggcagctggagtggcgtctgctgacgtcactggcgatgacgatgacgaagaccagtacgaggactgatcggccgtaccttttgttagatgcagcgaccggcgatcatcgcggagagggctcctaacctggatcccgcggttttggcggccatgcaaagccagccttctggcgttacagcttcagatgactggacagcggccatggatcgtattatggctttaacggcgcgcagtcctgatgcttttcgccagcagccccaagctaaccgcttttcggccattttggaagcagtagtgccgtctcgtactaaccctactcacgagaaagtgttaaccattgtaaatgctttgttggatagcaaagccatccgcaaagatgaggctggtttaatatacaacgctttgcttgagcgcgtggcacgctataacagtaccaatgtgcaggctaacttagaccggatgggtacagatgtaaaggaggcgctggctcaacgagagcgctttcatcgcgatggtaatcttggttcgctagtagcattaaacgcttttttgagtactcagccggctaatgttccgcgtggtcaggaagattatacaaacttcatcagcgccttgcgactaatggttactgaagtgcctcaaagtgaagtgtatcagtctggacccgattacttttttcaaacgtccaggcagggtttgcaaaccgtaaacttaactcaggcttttaaaaatttgcaaggtttgtggggggttcgtgctccagtaggcgatcgttcaactttgtccagtttactaacaccaaactcgcgcctattactgttgctaattgccccctttaccaacaccaacagtttaagtcgagattcatacctgggtcacttagttactttgtaccgcgaagccattggtcaagcgcaggtagacgaacaaacttatcaagaaataaccagtgttagtcgcgcactgggccaggaggacactggcagtttagaggccacacttaactttttactaactaaccgtcgccagcaagtgcctcctcagtacactttaaatgcggaagaagaacgcatattgcgctatgtacagcaatctgtaagtttgtatcttatgcgtgagggtgccacccccagtgccgccttagacatgacagcgcgcaatatggagccgtccttctacgcttccaatcgagctttcattaatcgcttgatggattaccttcaccgcgctgcggccatgaacggggaatactttacaaatgcaattctaaatccgcattggttgccccctcctggattttacactggtgaatttgatttgccggaaggaaatgatggctttttgtgggatgatgttacggacagtctgtttagtcctgcagttattggacaccatggtaaaaaggaagcaggtgatgaaggtcccttgcttgactctcgggcgagttctccattccccagtttaactagtttacccgccagtgttaacagcggtcgtaccaccagaccccgactaacaggtgaaagtgaatacttaaatgaccccatcttgtttccagtgcgcgacaaaaattttcccaacaatggcatagaaagtttggtagataaaatgtctcgctggaaaacatatgcacaagagcggcgagaatgggaggaaagacagccaagaccagttcgccctcctaggcaacgttggcagcgacgcaaaaaaggggcacatgcgggggatgaaggaagcgatgactcagctgacgacagtagtgtattagatttaggagggtcaggaaacccatttgctcatttgcgcccacagggttgcatagggtcattgtattaaattgaataaaagcatacttaccaaagccatggcgaccagtgttcgtcttattttccttcttccgttagctgtgaaatgaggcgcgcggtggaactgcagacagtggcttttcctgagacaccacctccctcttacgaaaccgtgatggcagcggcgccaccctacgtgcctccccgctatttgggtcctacggagggaagaaacagtatccgttactcggaattgtcaccgttgtacgataccactcgagtgtacttggtggacaacaagtcttctgacattgcttcattgaattaccagaatgatcacagcaactttttaaccactgtagtgcaaaataatgactattcccctatagaggctggcacgcaaactattaactttgatgaaaggtctagatggggtggagatttaaaaaccatcttacataccaacatgccaaacgtgaacgattttatgtttaccaccaaatttaaggccagggtaatggtggctaggaaaacaaacaacgaaggccaaaccattttagaatatgagtgggcagaatttgtgctacccgagggtaactattcggaaaccatgactattgacttaatgaacaatgctattattgagcattatttgcgagtaggaagacagcatggagtgctggaaagtgacattggagttaagtttgacaccagaaactttcgtctgggttgggaccccgaaacccaattagtaactccgggagtgtacactaatgaggcttttcatccagatatagtactgcttccaggttgcggggttgattttacagagagcagattaagcaacatactaggtataagaaagaggcagccgtttcaggaaggatttgtgattatgtatgaacacttagagggaggcaatattccagctcttttggatgtaaaaaaatacgaaaacagtctgcaggatcaaaacactgtaagaggagacaactttattgccttaaataaggctgctaggattgaaccggttgaaacagaccccaaaggacgcagttacaacttgcttccagacaaaaaaaatactaaatatcgcagctggtatttggcatacaactacggagacccagaaaaaggagttcggtcatggactctactaacaactccagatgtaacaggcggctccgaacaggtgtactggtccctacccgatatgatgcaagatccggtgacttttcgctcctcgcgtcaagttagcaactatcctgtagttgcagcagaattactgccagttcatgctaaaagcttctacaacgagcaagccgtctactcacagcttattcgccagtcaaccgcgcttacgcgcgtgtttaatcgctttcccgagaaccagatactggtgcgtccaccagccgctaccatcactaccgtcagtgaaaacgttcccgcccttacagatcacgggaccctgccgctgcgtagcagtatcagtggagttcagcgagtcaccatcactgacgcccgccgccggacctgtccctacgtttacaaagcactgggcatagtttctccacgagtgctttctagtcgcactttttaaaaaagtgtggtaacatgtccattttggtttcgccaagtaacaacacgggctggggactgggtgccgcccgcatgtatggaggagctaaaacaaggtctagccaacatccagtgcgcgtacgcggacattaccgagctccatggggcgcgcatacccgaggacgcactggtcgcaccactgtagacgatgttattgactcggtagtggccgatgctcgcaagtaccgcgcgcccgctgaaacagcagggtctactgttgatgcagtaattgatgaggtagtggcaaacgcgcgggcttatgcaaggcgccgcagacggctgcgtcgccggcgtagaccaaccaccgccatgcgcgcggccagagcgttggttcgacgggccaggcgcattgggcggcgagctatgatgcgggcagccaggcgggctgcaacgcctgccggtcgagcgcggagacgggccgcagctgcggccgcaacagctattgcaaacctagctgctccgcgacgaggaaatgtatactgggtgcgcgactcagtgaccgggacgcgtgtgccagttcgtacgcgtccacctcacccttagaagacaaagagtgactcaatgtctgttatgtatgcccagcatgaccaaacgcaagttcaaagaagagctgctgcaggccttagcgcctgaaatatatggcccatcggataaccttaccaagcgcgatatcaagcatgttaaaaaacgggaaaaaaaagaggaagaagtcgccgcggcgtcagcagacggcgtcgagtttgtgcgctcatttgcgcccagacgtagggtacagtggaagggacggcaagtaaaacgcattttgcgaccgggcaccacagtggttttttctcccggagagcgaacgattatgcgtcccctaaagcgcgagtacgacgaagtgtacgcagacgatgacattttggagcaagcggcacaacagactggggaatttgcatatggaaaaaaagggcgttacggagacaaaattgctattcctttggacgagggaaatccaacacccagtttaaaggctgtcactttgcaacaagtgttgcccgtccttgggccttcggaagaaaagcgtggaattaaaagggaagccatggatgaattgcagcctacaatgcaactgatggtgcctaagcggcaaaagttagaggacgtactagagcacatgaaggtggatcctagcgtacagccagatgtaaaagtacgtccgataaaaaaggtagctccaggattgggagttcaaacagtggacattcaaattcctgtgcaaactgcattgggtgaaactatggaaatccaaacttcgccaataaaaacaacggtgaacgcaagcgtgcaaacagacccttggtacccgccagtgctttcaacaaaaaaaaagcgtcactacagacaaacaagttcgcttttgccagactacgttttacatccttccattgtgcccacgcctgggtaccgtgggacaacttttcagcgccgagccacagcccctagccgtagacgaggtccatcacgccgtagacgtcgacgcaaagccactttagccccagcggcagtacgtcgcgttgtacaaagggggcgcacactaatacttccatccgtgcgttaccaccctagcattctctaacaagctgcgctgccgttttttcagatggctcttacttgccgaatgcgcatacccattccaggatacagaggacgaccccgccggaggaaagggctgaccgggaacggtcgatttcggcggcgtagtatgcgcagacgcatgaagggtggggtgctgcccttcctaattccacttattgctgcggccattggagccgttcccggaattgcctcagtagccttgcaggcttctcgaaaaaattaaaataaaataaaacttccaacttattactggtactatgactgttttatgcagactaaatggaagacatcaatttttcgtcgctggccccgcgacacggcacgcggccgtacatgggcacctggaacgagatcggcacgagccagctgaacgggggcgccttcaattggaacagtatctggagcggtcttaaaaattttggttccacgattaagacatatggcaccaaggcgtggaacagccaaaccggccagatgctaagggacaagttaaaagaccaaaattttcaacagaaagttgtagatggtctggcttcgggaattaatggagttgtagacatagccaatcaggctgtacagaaaaaaattgccaaccgtttagagccgcggcccgacgaggtaatggtagaggaaaagctgccacctctagaaactgtgcccggatccgttccaaccaaaggagaaaagcggccacggccggatgcagaggaaaccttagtaacgcacacaacagaaccgccgtcctatgaggaagcaataaaacaaggagccgctctgtcacctaccacctatcccatgaccaagcctattttacccatggctactagagtgtatggaaaaaacgaaaatgtgcctatgacccttgagctgcctcctttgccagaacccactatcgcggatcccgtaggttccgttcctgttgcatctgttccagttgcatcgacagtgagccgtccagcagtgcggcctgttgccgtggctagcttgcgaaacccacgatccagtaattggcaaagtaccctaaacagtattgtgggactgggagtaaagtctctcaaacgccgacgctgctactaacattaaaagacgagtgttaattcccatctgtgtatacgcctcctatgttagcgccagaggaccaacgcgtgaatcgcagtcaccaccagcgctttcaagatggccactccctcgatgatgccgcagtggtcttacatgcacatcgccggtcaggatgcctcggagtacctgagtcccggtctggtgcaattcgcccgcgccacggacacctacttcaccctgggaaacaagtttagaaaccccaccgtggctcccacccatgatgttaccaccgatcgctcgcagcgtctgacgctgcgttttgtgcccgtggatcgggaagatactacctactcctacaaggctcgctttacgctggctgtgggtgacaaccgcgtgttagacatggctagttcttactttgacattcgaggggtactggatcgtggtcccagttttaagccctattccggaaccgcctacaattctttggcaccaaaaggcgctcctaatgcttcacaatggtcagataacgctaagcttaatacctttgctcaggcgccgtatcttagcgacactatcaccgccgccgatggtattaaagttggaacagacaccgcccaggcaggcgcggcggtgtatgccaacaaaacttatcagccagagccgcaagtaggaccaagtgaatggaacaccagcattgaaaacgttaaagctggcgggagggcattaaagcaaaccactgcaatgcagccgtgctatggctcctacgctcgtccaaccaacgaacacggaggacaatccaaggatgacaacattgaacttaagttctttgattcagctaacaatgcagcaaacactgctcaagttgtgttctataccgaagacgtaaaccttgaaatgccagacacgcatcttgtgtttaagcctactgttaccaatggaacaattgcttctgagtcgctgttgggacagcaagcagcgccaaatagagcaaactacattgcattcagagataattttattggcctgatgtattacaacagtacaggcaacatgggtgtattggccgggcaagcttcccaacttaacgcagtagtagacctgcaagacagaaatacagagctgtcataccagttaatgctggatgctttgggagacagaacacggtacttttccttgtggaattccgcagtggacagttacgaccctgacgttcgcgttattgagaatcacggggtagaggatgaactaccaaattattgctttcctcttagcgcagtaggtgaaataaaaaattacaaaggcattaagccagataacggaggaggaggtggctggactgccgacaacactgtcagtgaagcaaaccacataggcattgggaatatagccgccatggaaattaatttgcaggctaatttgtggagaagcttcttgtactcaaatgtgggcttatacctaccagacgacttaaaatacactccaggaaacataaaactacctgataacaagaacacctacgagtacatgaacgggcgtgtgactgccccggggttggtggatacctatgtcaatatcggcgctcgctggtccccagatgtgatggataatgtaaacccttttaaccaccaccgaaacgcagggttgcgctacagatccatgttgctaggcaatgggagatttgttccttttcacattcaggtgccgcaaaaattttttgccatcagaaatttgttgctgttgcccggttcctacacttacgaatggaactttagaaaggatgtaaacatgattcttcagagcacactgggaaatgatcttcgggtggacggagccagcgttcgctttgacaacattgccctgtatgctaacttttttcccatggcacataacacagcttctactttagaagccatgttaagaaatgacaccaacgaccagtcttttaacgattatttgtgtgctgcaaacatgctgtatcccatcccagctaacgccaccagcgtgcccatttcaataccttcgcgaaattgggcggcatttagaggctggagctttactcgcctaaaaactaaagaaactccttccctgggttcagggtttgacccctactttgtatactctggaaccattccctatttagacggcaccttttacctaaaccacacttttaagaaggtgtcaatcatgtttgactcctccgtgagttggcctggaaatgaccgtttgctaaccccaaatgaatttgaaataaagcgttctgtggatggggagggatacaatgtggcccaatgcaatatgactaaggattggttcctaatacaaatgcttagtcattacaacattggataccaaggtttttacattccagagagctacaaggaccgcatgtattctttctttagaaactttcagcccatgagtaggcaagttgtggataccacagaatataagaactacaaaaaagtaaccgtagagtttcaacataacaactcaggattcgtgggatacctgggccccactatgcgggagggacaagcttaccccgccaactatccctaccctcttataggccaaacagctgtggaaagcatcacacagaaaaagtttctatgcgatcgtgttatgtggcgcatcccattttctagtaacttcatgtctatgggggcgctaacggatcttgggcaaaatatgctgtacgcaaactcagcccatgctctagacatgacatttgaggtggatccaatggatgagcctacccttctttatgttttatttgaagttttcgacgtggtacgcattcaccagccacaccgcggcgtcattgaagcggtctacctgcgcacgcccttctcggcgggtaacgctaccacctaagaaggcaccctcccagactgctgtaatgggttcaagcgaacaggagctgacggccattgttcgagatctaggctgtggaccctattttttgggaacctttgacaaacgttttccgggttttgtgtctcgcgaccgcttatcatgtgctattgttaacactgccggtcgcgaaactgggggcgtacactggctggcttttggatggaaccccaaatcgcacacttgctatttattcgatccatttggattttctgatcaacgactaaaacaaatctatcagtttgagtacgaaagtctgttgcgccgtagtgcgctagcggccactaaagaccgatgcgttaccctagaaaagtcaacccaaactgtacaaggaccgttttctgcagcgtgcggcctgttttgttgtatgttcttacacgcttttactcactggcctgaccatccaatggataaaaatcccactatggacctacttactggggtgcctaattgtatgctacaaagtcctcaggtagtgggcacattgcaacgcaatcagaatgaattgtataaattcttaaacaatctgtccccttactttcgtcacaaccgcgagcgcatagaaaaagctacatcttttactaaaatgcaaaatggactcaaataaacgtgtacacaatgcattaataataaaaccattttattagctcattggagtacaagcttgactgttttattaaaaatcaaatggctcttcgcgacagtcgccgtggttggtgggcagggatatgtttctgtactgcaaacgctgatgccacttgaattctggaataacaagcctagggggggagccgtcaaaattttctccccacagctggcgcacaagttgcagggcgcccataacatcaggagcagaaatcttgaagtcgcaattagggccagcattgccgcgcgcattgcgataaactggatttgcgcactgaaaaaccaacaaacacggatacttaatactggctaacgctccagggtcggttacttcgttgatatcaatgttatccacattgctgaggttaaaaggagtgattttacacagttgacgccccatccgtggcaggccatcttgcttgtttaaacattcgcagcgcactggcataaggagacgtttttgcccatgtcgcatgtgagggtagtcggccagcataaaagcttcaatttgcctaaaagctatttgagccttcattccttcagaataaaacaagccgcaggactttccggagaaagaattattcccgcagccaacatcatgaaaacagcagcgggcatcgtcgtttttaatttgaactacattacgcccccagcggttttgcgccaccttggctttcgaggggttctctttcaacgctcgttgcccactttcgctggttacatccatttccaccaaatgctctttgcgcaccatctccattccatgcaggcatctaagctccccttcgcgctcggtacacttatgctcccacacgcagcaaccggtgggttcccaggaattctgttggacaccggcataagcttgcatatatccttgcaaaaagcgtcccatgagctcctgaaaggttttttgggatgaaaaagtcagctgcaaaccgcgcttttcttcgttgagccatgttgtgcatattttcttgtacacgctgccctgatccggcaaaaaacgaaaggtggcgcgctcgtcgtgatccacatggtacttttccattagcatagccatggcttccatgcctttttcccaagctgaaactaggggctggcttgccggattgcgaacaacaacaacattcttttcattttcgtcgctgttttgagcggaagccttcaaaacgtgtacctgcctggtttccattttttgaaaagactgagaaccgtctgcatgatgcataatgcggacgggcggcatgctgaaacccattactcctaaaactgctcttggtggttctgcctcttcttcttctgcactctctggggaaagaggtatcgcagccatagatttcttgacttttttctttggaggtaaaggcacagcttccagttcttcttcgctttcggaatccagaaagtatctgcccatttttggcggcggcggctgagcgctgcggtctggggtgcgctccctctgtgagtgctgattgctggccattatttaatcctaggcaaagaaacacatgatggatctggagccacaggaaagcttaaccgcccccaccgctcccgccattggcgctacggctgtcatggagaaggacaaaagtctactcataccccaagacgcaccggttgagcagaacttgggctacgagactccccccgaggaatttgaaggctttcttcaaatccaaaagcaaccaaatgagcaaaacgctgggctcgaggaccatgactacctaaacgagggagatgtcctgtttaaacatctacagcgacaaagcactatcgttcgcgacgccatatctgatcgctcttcaataccagtttcaattgcagaactatcttgcatctacgaacgcaacctgttctccccacgtgtgccccctaaacggcaagccaacggcacatgcgagccaaatcctcgccttaacttctacccagtttttgcagtgccagaagcactggcaacataccatattttctttaaaaatcacaaaatacccctatcctgtcgagctaaccgcagccgcgcagatgagcttcttgctttaagggctggcgcttccatacctgggattgtgtccttggaagaggtgcctaaaatttttgaaggtttaggtcgggatgaaaaacgagcagcaaatgccctgcaaaaagaaaatgaacaaaatcaccatgggaatagtgctctaatagaactggaaggtgacaatgcccgcctggcagttttaaagcgcaatattgaggttactcactttgcctacccggcagtaaatcttccgccaaaggtaatgagcgcagtgatgaatcagctactaattaagcgagcccaacccattgacaaagatgcaaacttgcaagacccggaggcaacagatgatggaaagccggttgtaagcgacgagcaattaactaagtggttgggaacagacaattccaacgaactacaacagcggcgtaaactcatgatggccgccgtacttgtaactgtggaactcgagtgcatgcatcgttttttctccgacatcaccacattgcgcaaaattgaggaatgtcttcactacactttccgccatggctacgtgcgccaagcctgtaaaatttctaatgtggagctgagcaatctagtttcttacatgggcatcttgcatgaaaaccgattgggacagaacgtgctacactcaacactacgcgatgaagcacgcagagattacgtgcgagactgcatttaccttttcctgttacatacctggcaaactgggatgggtgtttggcagcaatgcttggaagaaaaaaaccttcgagaactaaacaaactgttagacagagcactaaaatccctatggaccggttttgacgaacggacagtagctgcagagctagctgacataattttcccagaaaggttaatgataaccttgcaaaacggcttgcctgactttatgagtcaaagtatgctgcacaattatcgctcttttatattagagcgttctgggatgcttcctagcatgtgttgtgcacttccttcagattttgtgcctatatattttagagagtgcccccctcccctgtggagccactgctacttactacgacttgctaactacctagcttaccactcagaccttatgacagattcaagcggcgaaggcctaatggagtgtcactgccgctgcaatctttgcaccccccaccgttctttggtttgcaatactgaactattaagtgaaagtcaagtcattggtaccttcgaaatgcagggaccgcagtctgacagcaatttcacgacgaacctaagacttacccctgggctttggacttctgcctacctgcgcaaatttgaaccccaagattaccacgcccacagtatcaatttttacgaagaccaatccaaacccccaaaagcgccactaacggcttgcgtcattacgcagggaaaaattctagcccaattgcatgctattaagcaagcgcgcgaagagtttttacttaaaaaaggacacggagtgtaccttgatccccaaaccggcgaggaactaaaccttccatcacctttgtgtgctactgcgtctccccattcgcagcatgtccccgaaagccgcaaaacaggctattgcgcagcaacgctcaaagaaacagcagcaacggcaggaaatctgggaggaagaatcttgggagagtcaggcagaggacgaggtcgaggacttggaagaatgggaggaggaggaggcggacagcctagacgaggatccagaggaggaggaggaaggttccaaggacggagcgaccgccgccaaaccgtcgctttcaaccaagccctctccaatgaaacccgctgtgagcaaatctcagaaagccaaccgtagatgggacaccattgaaaccagcgccgcaaacttgggtaagaatcgcaagcaggcgcgtcggggctactgctcatggcgggctcaccaaagtaatattgtagcctgctttcagcactgcggggggaatatctcatttgcaaggcggtatttgctataccatgatggagtggcgattccaaggaatgtcctccattactaccgtcatctctacagcccctttgaagagctcgacaaggaaccgacctgcaacagccaagcggcccactagaatcggcaacagcagcaacaaggaaagtcctgaggcgcgcgagttaagaaaacgcatttttcccactttatatgctatttttcagcagagtcgaggtcaagaacacgaactgaaaataaaaaaccgttccctgcgttcacttacccgcagctgtctctacctcaaaagcgaagatcagttgcaacgcaccttgcaggacgcagaagctctgttcaataaatactgctccctctcgcttaaagagtaaaaaaagcccgcgcgcggactttcaacaggcgggaaaagtgacgtcacaacaagatgagtaaagatattcccacgccttacatgtggagctttcaaccccaaatgggactggcggccggcgcggctcaagactattctagcaaaatgaattggttaagcgccggaccccacatgatttccagggtgaatggggtacgagcccggcgtaaccaaatactgctagaacaagccgctctcaccgctacaccacgtaatcaacttaaccctccctcttggccagctgccctgatatatcaggaaaatccccctcctaccactgtacttttgcctcgcgacgcccaggccgaagtccatatgactaacgctggggcacagcttgcgggcggtgcacgtcacagtttcaggtataaaggtcgcactgagccctatccgtctccagctataaaaagagtactcatcagagggaaaggtattcagctgaacgacgaagtcacatcgccattgggagtcagacccgacggagtgtttcagctcggagggtccggacgttcctcctttaccgctcgtcaagcctacctgacactacagagctcatcctcagctccgagatctggtggtattggaactctccaatttgtggaggaatttactccatctgtttacttcaatcctttttcgggctcgcctggacactatcctgacgccttcatacccaactttgacgcagtgagtgaatctgtggatggctatgattaatgtctaatggagcggctgacagagcgcggctgcgacatttagaccactgtcgccaacctcactgctttgctcgagacatctgtgtctttacctactttgagcttccagaggagcacccccaggggccagctcacggtgtcagaataacagttgaaaaaggaattgatacacacctcattaaatttttcaccaaacgcccgctattggtggaaaaagatcaaggaaatactatattaactttatattgcatttgtcctgttcccggattacatgaagatttctgctgtcatttgtgtgctgaatttaatcatctgtagtggcgctgtaccgcctgaagaagaacctaactgtcatccgcatttaagcaacattaaaatcaacctttcgatccctcatatcactcttcgctgcagttttttttccacacatctcacctggacctttaacggaaaacacgttaccaatacagatataaagtttaaactacacaaagaaaacatcactctatttcaacctattaacctgggatactaccgctgctcagctccaccctgtacgcaagcattttttgttgctccagttattgacaaacgccctgctccgacaacagctgctgtcactgagcacatcaccgaggcagtttctccttctaaaggtacagaggaaattgtgtacttttcaaactttacaaaccacttagttttaaattgttcctgttctaactccttaatttcatggtttgctaacagctctctgtgcaaaactttctaccaaggaaaacttttgtattctgctaaactcacattgtgtaaccagagcaccccttcccaccttactctattgccaccttttgttgccggtcgttacttttgcataggagctgcacgtactagcccctgtcaacagcattggaatttaacttactgtcccccaccagtgtcgccctttgtgatcaatactgaatatttagactataatcccttgcttgcttacggcggtctcgcagctcttattttattcctgatttctaacttgtttctagtgcaacatttgtattcatactaacaatgctttccatttttcttttatttctcttttctttaccttctggcttgtatgctcaaacagccgaaagaccactaaaagtcgtggtggaagctggccataatgtaacccttccccacctttctggttcacaccaaactggccatgttacttggctagtagagacatcagattatggttcagcttctccagacaacttcattttcagtggacaaaaactatgccagtttactgacagaaccatggtgtggccttattacaatttacattttaactgtgaaaattatgaccttaatctgttttggcttaaggtggaaaattcggctatttacaacgttaaaaatacagtcaatgcttctgaaacaaatatttactatgatttaagagtagtacaaatttttccacctaaatgcatcattacttcaaagtaccttacaaacgattattgtcacattacaattaactgcactaactctgattaccccaataaggttgtgtttaataatgtcagtcgatggtactacggatacggtaagggcagcccaacccttcccaactactttataactaactttaatgtttcaggtattactaaaagctttaatcacacttacccttttaatgagctctgtgattatcccacatcccaatctcaacacagtttaacacatacagtaagcacagtaatctttttaggaataattggcttcagcattttgattattatagcagcctttatttatctgtgctggcatagaaaatctttgtgtgtttctaaaacagaacctcttatgccgattccttactagttttcttttttcttacagtatggtgacggttcttctcatctttttatgcctgccagtcattttttcttcttcgacttttgccgcagtcagtgaccttgatcccgagtgtttagccccctttgcggtgtacctgattttcacatttgtgactgctacctgcgtctgcagtattattactctgctaatcacctcgctccaattttttgattactactacgtgagaattgtttaccgcagacaccacccccgttaccaaaaccctcaaattgcggctcttttgcagctccaaccatgaaaacagcattagttcttttctttatgttaatcccagtttgggctagttcttgtcaactacataaaccatggaattttttagattgttatactaaagaaacaaactacataggctgggtttatggaattatgtctggcttagtatttgtctcctctgtagtttctttacaactgtatgcgcgccttaattttagttggaataagtatactgatgatcttcccgaatatccaaacccccaggatgatttacccctaaatattgtatttccagagcccccgcgtcctccttctgttgttagctattttaagttcaccggtgaagatgattgaacctgatctagaaattgatggaagaatcaccgaacagaggctcctcactgatcgcgctaggcgacgccaacaggatcaaaaaaataaagagttaattgatttacaaaccgtgcatcagtgtaaaaaaggacttttttgcctggtaaaacaagctacccttcgctatgaatctttaccaggcaaagaacatcaactgtgctacacgctgcccactcagcgacaaacctttactgcaatggtgggctcggtacctattaaagtgtcccaacaagcaggagaacaagaaggctctattcggtgcctatgtgataaccctgaatgtttgtacactttaataaaaacactgtgcggtttaagaaatcttttaccaatgaattaaataaattacttaccggaaatctgaaaatacatcatggtctccgtgtactcttataaaatttccctcttcccaactgtcaaacctgacagacttgcaaacagcaaactttctccaaatcttaaatggaaggtcagattcttcttcccaatccctacccaccatcttcatcttttctagatgaagcgcagcagaacccagtatgctgaagaaacagaagaaaatgatgacttcaaccccgtttacccttttgacccatttgacacatcagacgtaccctttgttacacccccttttacttcttccaatggtcttcaagaaaaaccaccaggtgtattagcacttaattacaaagaccccattgtaactgaaaatggaacccttacactcaagctaggggacggaataaaacttaatgcccaaggtcaacttacagctagtaataatatcaatgttttggagccccttaccaacacctcacaaggtcttaaactttcttggagcgcccccctagcagtaaaggctagtgccctcacacttaacacaagagcgcccttaaccacaacggatgaaagcttagccttaataaccgcccctcccattacagtagagtcttcgcgtttgggcttggccaccatagcccctctaagcttagatggaggtggaaacctaggtttaaatctttctgctcccctggacgttagtaacaacaatttgcatctcaccactgaaactcccttagttgtaaattctagcggtgccctatctgttgctactgcagaccccataagtgttcgcaacaacgctcttaccctacctacggcagatccgttaatggtgagctccgatgggttgggaataagtgtcactagtcccattacagtaataaacggttccttagccttgtctacaactgctcccctcaacagcacaggatccactttaagtctgtctgttgccaatcctctgactatttcacaagacacattgactgtttccactggtaacggtcttcaagtgtcggggtctcaattagtaacaagaataggggatggtttaacattcgataatggggtcatgaaagtaaacgttgccgggggaatgagaacttctggcggtagaataattttagatgttaattatccctttgatgcgagcaataacctgtccttaagacggggattgggactaatttataaccaatctacaaactggaacttaacaactgatattagtaccgaaaaaggtttaatgtttagtggcaatcaaatagctcttaatgcaggtcaggggcttacatttaataatggccaacttagggttaagttgggagctggacttatttttgattcaaacaataacattgccttaggcagcagcagcaacactccatacgaccctctgacactgtggacaactcctgacccaccaccaaactgcagcctcatacaagagctagatgcaaaactcaccctgtgcttaacaaaaaacggatctattgttaatggcattgtaagtttagtgggtgttaagggtaatctcctaaatatccaaagtactactaccactgtaggagtgcatttagtgtttgatgaacagggaagattaatcacatcaacccctactgccctggttccccaagcttcgtggggatatagacaaggccaatcagtgtctaccaatactgttaccaatggtctaggttttatgcctaatgtgagtgcttaccctagaccaaatgccagtgaggctaaaagccaaatggtaagtctcacgtacttacagggagatacatctaaacctataacaatgaaagttgcatttaatggcattacgtcgctaaatggatactctttaacattcatgtggtcaggtctatcaaactatataaatcagcctttctctacaccatcctgctccttttcttacattacccaagaataaaaacacacacaaaacacaaattgcgtacttattgtttatttttttttttttttacactatacgcgtggttaaactgcctccttcccattttaccttgtatacctccctttccccctttgtagctgaaaacaactgcacttgaatatttcgacttaggttttttggcgttagcgtccacacagtttctttacgggcaaagcgagggtcggtgatggaaacgaatccctcgcccgcacagtcactcaagcggcattccccatccaaaaccaggtccatgattttatcctacaaaaagtaacaacagtcagtgtccatcagccgcccaaggattctctcgttgattataatctccaaataaaattgctcgatgatgcataattaaaccctttagcagttgctgacgataacgttcatgccgactatgttttagagggcgaacagtgttttcagcaattacttgaacaacttttaacattagcagtctggtacgacgagcgcaacagcgcatgcgtatctcacttaagtctttacaataatcacaacacagcactaacatgttatttaaaattccataattaaaggcgctccatccaaaactaactttttctaacgctaaccaggcatggccatcatacataattttaaagtaaattaaatggcgacctctaacaaaggtgcttcccacatacatcacctctttaggcattaaatggttaacaacctcccgataccaaaaacaccttttgttaattaaggcgccatatacggccattttgaaccagcgtcccaaaagcatcccagctgacatacactgtagtgaacccggacgctggcaatgacaatgaataagccaccgctcatgaccatgtaataattgagtaacttcaacatttatagtggcacaacacatacatacactcatgtattttttcaaaataaacatctcataatcagttagaatcatatcccacggtattggccattcctgcagcactgtaaaacctacacatgaaggaatgcctcttacctcacttacattatgtaaagtcagactattacactcaggccataaagaattttccgaagtactcaacgtagcttttgactgttcctcacagggcggtagttggtacttgttgtatggtgccaatctgtagcgataccgtctgtcgcgctgcatcgtaaacaacagacttgcgagcgtcttcgtacttaaaaaaacaaaaccacgtacgaccactggttatcgcacctcgtcctttttgtttgcagcgttggcgttccgtcaaaaaagcaaagtacaaccactctcgcaggcttgctaaaatgtattcagcttcaggtgttatcttcaaatcatgatgtttaataaagcgcagagtatccacacaggatgcatgggctaaaccaagccatgctatgcaggcagccgtgtcccgacttacaggaggaggaggaatacaaggtagaggcataaaaacttaatcaagacggtcagcaaggatttgaatgcgtaaatctcgcaggtggcagcgatcgcctccgctgtgctggtgaaagatcacagccagatcaaattgtaagcgattttccaaatgttcaacaacagcttctaaaagagccacagctctgatttcgataaacaaaagcaaagcaaatgcattatcatgaaactcttctatcatcaaactgcctgactgaaccattcccaggtaattttcattcttccactgttgtattatttgaacacactgattttgcaggtttaaaccgtgaatattaaaaagctctgtaagggcgccctccaccgccatccgcaggcagtacttcatatttgctgaaaaaagtctggatcttcaaacacctgcagtaaattcagtagatttacattaggctccacaccttggtctcgcagctgacatcttaatgccagttgtataaaatcatacaaatcagaagccagcagcaaagaaagttcacctccaggtacaagttccggagttcccacagaacatacaacttgcacaaatggacccatattagtaagcgtggcgccaacgtagacatcgcgcataggaggagttaaataatgcattaccagcagccaaaactcaggtagcacgtctttaagaaacgtcaccacctcaaaatctaagccatgcaaatagttccgtaaagactccggaaacaacacggagtaatgaacaagcgacctctgaaacatgctttaggttagcctgaaaaataaaaatatgttaaattaaagatgcctggcaaacgggtggaaaaacaactctacttaaaagcaagcgcgcgactggctgctttgcgcgaacatcgcaaaacacgtcggaatgattaaacaacaaaacactgagctccattcttgagcctggataaagcgtttcagcgccaacaaaaacccctctggcgttcatgtcgcataatgaaaacaatgttcccaaatatccaggaggaatatcaactgctatgtgcaaatataaaagcacaactccatgtggaggtataacaaaattcgcaggagaaaataacacataagcattagagtcgccctcttgtttaggcaacatagccccaggtcccgtaaaatacacataaagagtctcaaaagcagccataatgccttaccagaaaaacagtacaaagccaggcacagcagacacaatctgccgcaagtgcgcacctttaatactgaaaaatagtgacgtaaatggccaaagttcgcctacacaacacaaaaaaaaccccaaaagcccgcgaaaaaaatcacttccgcatatgactcggcataatacggtgttctcacgacacgtcacatccggcgcgcccggctcccacgccgcgccccacttcctcatccgcccaaacttacaagcacgccaaagccacacctccacccaatcaaattacacactacgcccacttcattttaatattggcactagtccagtataaggtatattattagatagg

SEQ ID NO: 143 - DNA, 34775 bp, Human adenovirus type 34
catcatcaataatataccttatagatggaatggtgccaatatgtaaatgaggtgattttaaaaattgtggggtgtgtggtgattggctgtggggttaacggctaaacggggcggcgcggccgtgggaaaatgacgttttgtgggggtggagtttttttgcaagttgtcgcgggaaatgtgacgcataaaaaggctttttttctcacggaactactgacttttcccacggtatttaacaggaaatgaggtagttttgaccggatgcaagtgaaaattgctgatttgcgcgcgaaaactgaatgaggaagtgtttttctgaataatgtggtatttatggcagggtggagtatttgttcagggccaggtagactttgacccattacgtggaggtttcgattaccgtgttttttacctgaatttccgcgtaccgtgtcaaagtcttctgtttttacgtaggtgtcagctgatcgctacggtatttatacctcagggtttgtgtcaagaggccactcttgagtgccagcgagaagagttttctcctctgcgccggcagtttaataataaaaaaatgagagatttgcgatttctgcctcaggaaataatttctgctgagactggaaatgaaatactggagcttgtggtgcacgccctgatgggagacgatccggagccacctgtgcagctttttgagcctcctacgcttcaggaactgtatgatttagaggtagagggatcggaggattctaatgaggaagctgtgaatggcttttttaccgattctatgcttttagctgctaatgaaggattagaattagatccgcctttggacactttcgatactccaggggtgattgtggaaagcggtacaggtgtaagaaaattacctgatttgggttccgtggactgtgatttgcactgctatgaagacgggtttcctccgagtgatgaggaggaccatgaaaaggagcagtctatgcagactgcagcgggtgagggagtgaaggctgccagtgttggttttcagttggattgcccggagcttcctggacatggctgtaagtcttgtgaatttcacaggaaaaatactggagtaaaggaactgttatgttcgctttgttatatgagagcgcactgccactttatttacagtaagtgtgtttaagttaaaatttaaaggaatatgctgtttttcacatgtatattgagtgggagttttgtgcttcttattataggtcctgtgtctgatgctgatgagtcaccatctcctgattctactacctcacctcctgagattcaagcacctgttcctgtggacgtgcgcaagcccattcctgtgaagcttaagcctgggaaacgtccagcagtggaaaaacttgaggacttgttacagggtggggacggacctttggacttgagtacacggaaacggccaagacaataagtgttccatatccgtgtttacttaaggtgacgtcaatatttgtgtgagagtgcaatgtaataaaaatatgttaactgttcactggtttttattgctttttgggcggggactcaggtatataagtagaagcagacctgtatggttagctcataggagctggctttcatccatggaggtttgggccattttggaagaccttagaaagactaggcaactgttagaggacgcttcggacggagtctccggtttttggagattctggttcgctagtgaattagctagggtagtttttaggataaaacaggactataaagaagaatttgaaaagttgttggtagattgcccaggactttttgaagctcttaatttgggccatcaagttcactttaaagaaaaagttttatcagttttagacttttcaaccccaggtagaactgccgctgctgtggcttttcttacttttatattagataaatggatcccgcagactcatttcagcaggggatacgttttggatttcgtagccacagcattgtggagaacatggaaggttcgcaagatgaggacaatcttaggttactggccagtgcagcctttgggtgtagcgggaatcctgaggcatccaccggtcatgccagcggttctggaggaggaacagcaagaggacaacccgagagccggcctggaccctccagtggaggaggcggagtagctgacttgtctcctgaactgcaacgggtgcttactggatctacgtccactggacgggataggggcgttaagagggagagggcatctagtggtactgatgctagatctgagttggctttaagtttaatgagtcgcagacgtcctgaaaccatttggtggcatgaggtccagaaagagggaagggatgaagtttctgtattgcaggagaaatattcactggaacaggtgaaaacatgttggttggagcctgaggatgattgggaggtggccattaaaaattatgccaagatagctttgaggcctgataaacagtataagattactagacggattaatatccggaatgcttgttacatatctggaaatggggctgaggtggtaatagatactcaagacaaggcagttattagatgctgcatgatggatatgtggcctggagtagtcggtatggaagcagtaacttttgtaaatgttaagtttaggggagatggttataatggaatagtgtttatggccaataccaaacttatattgcatggttgtagcttttttggtttcaacaatacctgtgtagatgcctggggacaggttagtgtacggggatgtagtttctatgcgtgttggattgccacagctggcagaaccaagagtcaattgtctctgaagaaatgcatattccaaagatgtaacctgggcattctgaatgaaggcgaagcaagggtccgccactgcgcttctacagatactggatgttttattttaattaagggcaatgccagcgtaaagcataacatgatttgcggtgcttccgatgagaggccttatcaaatgctcacttgtgccggtgggcattgtaatatgctggctactgtgcatattgtttcccatcaacgcaaaaaatggcctgtttttgatcacaatgtgttgaccaagtgtaccatgcatgcaggtgggcgtagaggaatgtttatgccttaccagtgtaacatgaatcatgtgaaagtgttgttggaaccagatgccttttccagaatgagcctaacaggaatctttgacatgaacatgcaaatctggaagatcctgaggtatgatgatacgagatcgagggtgcgcgcatgcgaatgcggaggcaagcatgccaggttccagccggtgtgtgtagatgtgactgaagatctgagaccggatcatttggttattgcccgcactggagcagagttcggatccagtggagaagaaactgactaaggtgagtattgggaaaacttggggtggggttttcagatggacagattgagtaaaaatttgttttttctgtctttcagctgtcatgagtggaaacgcttcttttaaggggggagtcttcagcccttatctgacagggcgtctcccatcctgggcaggagttcgtcagaatgttatgggatctactgtggatggaagacccgtccaacccgccaattcttcaacgctgacctatgctactttaagttcttcacctttggacgcagctgcagccgccgccgccgcctctgttgccgctaacactgtgcttggaatgggttactatggaagtatcgtggctaattccacttcctctaataacccttctaccctgactcaggacaagttacttgtccttttggcccagctggaggctttgacccaacgtctgggtgaactttatcagcaggtggccgagttgcgagtacaaactgagtctgctgtcggcacggcaaagtctaaataaaaaaaaattccacaatcaatgaataaataaacgagcttgttgttgatttaaaatcaagtgtttttatttcatttttcgcgcacggtatgccctagaccaccgatctcgatcattgagaacacggtggattttttccagaatcctatagaggtgggattgaatgtttagatacatgggcattaggccatctttggggtggagatagctccattgaagggattcatgctccggggtagtgttgtaaatcacccagtcataacaaggtcgcagtgcatggtgttgcacaatatcttttagaagtaggctgattgccacagataagcccttggtgtaggtgtttacaaaccggttgagctgggaggggtgcattcggggtgaaattatgtgcattttggattggatttttaagttggcaatattgccgccaagatctcgtcttgggttcatgttatgaaggaccaccaagacggtgtatccggtacatttaggaaatttatcgtgtagcttggatggaaaagcgtggaaaaatttggagacacccttgtgtcctccgagattttccatgcactcatccatgataatagcaatggggccgtgggcagcagcgcgggcaaacacgttccgtgggtctgacacatcatagttatgttcctgagttaaatcatcataagccattttaatgaatttggggcggagagtacccgattggggtatgaatgttccttcgggccccggagcatagttcccctcacagatttgcatttcccaagctttcagttccgatggtggaatcatgtccacctggggggctatgaagaacaccgtttctggggcgggggtgattagttgggatgatagcaagtttctgagcaattgagatttgccacatccggtggggccataaatgattccgattacaggttgcaggtggtagtttagggaacggcaactgccgtcttctcgaagcaagggggccacctcgttcatcatttcccttacatgcatattttcccgcaccaaatccattaggaggcgctctcctcctagtgatagaagttcttgtagtgaggaaaagtttttcagcggttttagaccgtcagccatgggcattttggagagagtttgctgcaaaagttctagtctgttccacagttcagtgatgtgttctatggcatctcgatccagcagacctcctcgtttcgcgggtttggacggctcctggagtagggtatgagacgatgggcgtccagcgctgccagggttcggtccttccagggtctcagtgttcgagtcagggttgtttccgtcacagtgaaggggtgtgcgcctgcttgggcgcttgccagggtgcgcttcagactcattctgctggtggagaacttctgtcgcttggcgccctgtatgtcggccaagtagcagtttaccatgagttcgtagttgagcgcctcggctgcgtggcctttggcgcggagcttacctttggaagttttcttgcataccgggcagtataggcatttcagcgcatacagcttgggcgcaaggaaaatggattctggggagtatgcatctgcgccgcaggaggcgcaaacagtttcacattccaccagccaggttaaatccggttcattggggtcaaaaacaagttttccgccatattttttgatgcgtttcttacctttggtctccatgagttcgtgtcctcgttgagtgacaaacaggctgtccgtatccccgtagactgattttacaggcctcttctccagtggagtgcctcggtcttcttcgtacaggaactctgaccactctgatacaaaggcgcgcgtccaggccagcacaaaggaggctatgtgggaggggtagcgatcgttgtcaaccagggggtccaccttttccaaagtatgcaaacacatgtcaccctcttcaacatccaggaatgtgattggcttgtaggtgtatttcacgtgacctggggtccccgctgggggggtataaaagggggcggttctttgctcttcctcactgtcttccggatcgctgtccaggaacgtcagctgttggggtaggtattccctctcgaaggcgggcatgacctctgcactcaggttgtcagtttctaagaacgaggaggatttgatattgacagtgccggttgagatgcctttcatgaggttttcgtccatttggtcagaaaacacaatttttttattgtcaagtttggtggcaaatgatccatacagggcgttggataaaagtttggcaatggatcgcatggtttggttcttttccttgtccgcgcgctctttggcagcgatgttgagttggacatactcgcgtgctaggcacttccattcggggaagatagttgtcaattcatctggcacgattctcacttgccaccctcgattatgcaaggtaattaaatccacactggtggccacctcgcctcgaaggggttcgttggtccaacagagcctacctcctttcctagaacagaaagggggaagtgggtctagcataagttcatcgggagggtctgcatccatggtaaagattcccggaagtaaatccttatcaaaatagctgatgggagtggggtcatctaaggccatttgccattctcgagctgccagtgcacgctcatatgggttaaggggactgccccagggcatgggatgggtgagtgcagaggcatacatgccacagatgtcatagacgtagatgggatcctcaaagatgcctatataggttggatagcatcgcccccctctgatacttgctcgcacatagtcatatagttcatgtgatggcgctagcaaccccggacccaagttggtgcgattgggtttttctgttctgtagacaatctggcgaaagatggcgtgagaattggaagagatggtgggtctttgaaaaatgttgaaatgggcatgaggtagacctacagagtctctgacaaagtgggcataagattcttgaagcttggttaccagttcggcggtgacaagtacgtctagggcgcagtagtcaagtgtttcttgaatgatgtcataacctggttggtttttcttttcccacagttcgcggttgagaaggtattcttcgcgatccttccagtactcttctagcggaaacccgtctttgtctgcacggtaagatcctagcatgtagaactgattaactgccttgtaagggcagcagcccttctctacgggtagagagtatgcttgagcagcttttcgcagcgaagcgtgagtaagggcgaaggtgtctctgaccatgactttgagaaattggtatttgaagtccatgtcgtcacaggctccctgttcccagagttggaagtctacccgtttcttgtaggcggggttgggcaaagcgaaagtaacatcgttgaagagaatcttaccggctctgggcataaaattgcgagtgatgcggaaaggctgtggtacttccgctcgattgttgatcacctgggcagctaggacgatctcgtcgaaaccgttgatgttgtgtcctacgatgtataattctatgaaacgcggcgtgcctttgacgtgaggtagcttattgagctcatcaaaggttaggtctgtagggtcagataaggcgtagtgttcgagagcccattcgtgcaggtgaggatttgcatgtaggaatgatgaccaaagatccaccgccagtgctgtttgtaactggtcccgatactgacgaaaatgctggccaattgccattttttctggagtgacacagtagaaggttctggggtcttgttgccatcgatcccactttagtttaatggctagatcgtgggccatgttgacgagacgctcttctcctgagagtttcatgaccagcatgaaaggaactagttgtttgccaaaggaccccatccaggtgtaagtttccacatcgtaggtcaggaagagtctttctgtgcgaggatgagagccgatcgggaagaactggatttcctgccaccagttggaggattggctgttgatgtgatggaagtagaagtttctgcggcgcgccgagcattcgtgtttgtgcttgtacagacggccgcagtagtcgcagcgttgcacgggttgtatctcgtgaatgagctgtacctggcttcccttgacgagaaatttcagtgggaagccgaggcctggcgattgtatctcgtgctcttctatattcgctgtatcggcctgttcatcttctgtttcggtggtggtcatgctgacgagcccccgcgggaggcaagtccagacctcggcgcgggaggggcggagctgaaggaccagagcgcgcaggctggagctgtccagagtcctgagacgctgcggactcaggttagtaggtagggacagaagattaacttgcatgatcttttccagggcgtgcgggaggttcagatggtacttgatttccacaggttcgtttgtagagatgtcaatggcttgcagggttccgtgtcctttgggcgccactaccgtacctttgttttttcttttgatcggtggtggctctcttgcttcttgcatgctcagaagcgatgacggggacgcgcgccgggcggaagcggttgttccggacccggaggcatggctggtagtggcacgtcggcgccgcgcacgggcaggttctggtactgcgctctgagaagacttgcgtgcgccaccacgcgtcgattgacgtcttgtatctgacgtctctgggtgaaagctaccggccccgtgagcttgaacctgaaagagagttcaacagaatcaatttcggtatcgttaacggcagcttgtctcagtatttcttgtacgtcaccagagttgtcctggtaggcgatctccgccatgaactgctcgatttcttcctcctgaagatctccgcgacccgctctctcgacggtggccgcgaggtcattggagatacggcccatgagttgggagaatgcagtcatgcccgcctcgttccagacgcggctgtaaaccacggccccctcggagtctcttgcgcgcatcaccacctgagcgaggttaagctccacgtgtctggtgaagaccgcatagttgcataggcgctgaaaaaggtagttgagtgtggtggcaatgtgttcggcgacgaagaaatacatgatccatcgtctcagcggcatttcgctgacatcgcccagagcttccaagcgctccatggcctcgtagaagtccacggcaaaattaaaaaactgggagtttcgcgcggacacggtcaattcctcctcgagaagacggatgagttcggctatggtggcccgtacttcgcgttcgaaggctcccgggatctcttcttcctcttctatctcttcttccactaacatctcttcttcgtcttcaggcgggggcggagggggcacacggcgacgtcgacggcgcacgggcaaacggtcgatgaatcgttcaatgacctctccgcggcggcggcgcatggtttcagtgacggcgcggccgttctcgcgcggtcgcagagtaaaaacaccgccgcgcatctccttaaagtggtgactgggaggttctccgtttgggagggagagggcgctgattatacattttattaattggcccgtagggactgcgcgcagagatctgatcgtgtcaagatccacgggatctgaaaacctttcgacgaaagcgtctaaccagtcacagtcacaaggtaggctgagtacggcttcttgtgggcgggggtggttatgtgttcggtctgggtcttctgtttcttcttcatctcgggaaggtgagacgatgctgctggtgatgaaattaaagtaggcagttctaagacggcggatggtggcgaggagcaccaggtctttgggtccggcttgctggatacgcaggcgattggccattccccaagcattatcctgacatctagcaagatctttgtagtagtcttgcatgagccgttctacgggcacttcttcctcacccgttctgccatgcatacgtgtgagtccaaacccgcgcattggttgtaccagtgccaagtcagctacgactctttcggcgaggatggcttgctgtacttgggtgagggtggcttgaaagtcatcaaaatccacaaagcggtggtaagccccggtattaatggtgtaagcacagttggccatgactgaccagttaactgtctggtgaccagggcgcacgagctcggtgtatttaaggcgcgaataggcgcgggtgtcaaagatgtaatcgttgcaggtgcgcaccagatactggtaacctataagaaaatgcggcggtggttggcggtagagaggccatcgttctgtagctggagcgccgggggcgaggtcttccaacataaggcggtgatagccgtagatgtacctggacatccaggtgattcctgcggcggtagtagaagcccgaggaaactcgcgtacgcggttccaaatgttgcgtagcggcatgaagtagttcattgtaggcacggtttgaccagtgaggcgcgcgcagtcattgatgctctatagacacggagaaaatgaaagcgttcagcgactcgactccgtagcctggaggaacgtgaacgggttgggtcgcggtgtaccccggttcgagacttgtactcgagccggccggagccgcggctaacgtggtattggcactcccgtctcgacccagcctacaaaaatccaggatacggaatcgagtcgttttgctggttgccgaatggcagggaagtgagtcctattttttttttttgccgctcagatgcatcccgtgctgcgacagatgcgtccccaacaacagcccccctcgcagcagcagcaaccacaaaaggctgtccctgcaactactgcaactgccgctgtgagcggtgcgggacagcccgcctatgatctggacttggaagagggcgaaggactggcacgtctaggtgcgccttcgcccgagcggcatccgcgagttcaactgaaaaaagattctcgcgaggcgtatgtgccccaacagaacctatttagagacagaagcggcgaggagccggaggagatgcgagcttcccgctttaacgcgggtcgtgagctgcgtcacggtttggacagaagacgagtgttgcgggacgaggatttcgaagttgatgaagtgacagggatcagtcctgccagggcacacgtggctgcagccaaccttgtatcggcttacgaacagacagtaaaggaagagcgtaatttccaaaagtcttttaataatcatgtgcgaaccctcattgcccgcgaagaagtcacccttggtttgatgcatttgtgggatttgatggaagctatcattcagaaccctactagcaaacctctgaccgcacagctgtttctggtggtgcaacacagcagagacaatgaggctttcagagaggcgctgctcaacatcaccgaacccgaggggagatggttgtatgatcttatcaacattctacagagtatcatagtgcaggagcggagcctgggcctggccgagaaggtggctgccatcaattactcggttttgagcttgggaaagtattacgctcgcaagatctacaagactccatacgttcccatagacaaggaggtgaagatagatgggttctacatgcgcatgacgctgaaggtgttgaccctgagcgatgatcttggggtgtaccgcaatgacagaatgcatcgcgcggtgagcgccagcaggaggcgcgagttaagcgacagggaactgatgcacagtttgcaaagagctctaactggagctggaaccgagggtgagaattactttgatatgggagctgacttgcagtggcagcctagtcgcagggctctgaacgccgcgacggcaggatgtgagcttccttacatagaagaggcggatgaaggcgaggaggaagagggcgagtacttggaagactgatggcacaacccgtgttttttgctagatggaacagcaagcaccggatcccgcaatgcgggcggcgctgcagagccagccgtccggcattaactcctcggacgattggacccaggccatgcaacgtatcatggcgttgacgactcgcaaccccgaagcctttagacagcaaccccaggccaaccgtctatcggccatcatggaagctgtagtgccttcccgctctaatcccactcatgagaaggtcctggccatcgtgaacgcgttggtggagaacaaagctattcgtccagatgaggccggactggtatacaacgctctcttagaacgcgtggctcgctacaacagtagcaatgtgcaaaccaatttggaccgtatgataacagatgtacgcgaagccgtgtctcagcgcgaaaggttccagcgcgatgccaacctgggttcgctggtggcgttaaatgctttcttgagtactcagcctgctaatgtgccgcgtggtcaacaggattatactaactttttaagtgctttgagactgatggtatcagaagtacctcagagcgaagtatatcagtccggtcctgattacttctttcagactagcagacagggcttgcagacggtaaatctgagccaagcttttaaaaaccttaaaggtttgtggggagtgcatgccccggtaggagaaagagcaaccgtgtctagcttgttaactccgaactcccgcctattattactgttggtagctcctttcaccgacagcggtagcatcgaccgtaattcctatttgggttacctactaaacctgtatcgcgaagccatagggcaaagtcaggtggacgagcagacctatcaagaaattacccaagtcagtcgcgctttgggacaggaagacactggcagtttggaagccactctgaacttcttgcttaccaatcggtctcaaaagatccctcctcaatatgctcttactgcggaggaggagaggatccttagatatgtgcagcagagcgtgggattgtttctgatgcaagagggggcaactccgactgcagcactggacatgacagcgcgaaatatggagcccagcatgtatgccagtaaccgacctttcattaacaaactgctggactacttgcacagagctgccgctatgaactctgattatttcaccaatgccatcttaaacccgcactggctgcccccacctggtttctacacgggcgaatatgacatgcccgaccctaatgacggatttctgtgggacgacgtggacagcgatgttttttcacctctttctgatcatcgcacgtggaaaaaggaaggcggcgatagaatgcattcttctgcatcgctgtccggggtcattggtgctaccgcggctgagcccgagtctgcaagtccttttcctagtctacccttttctctacacagtgtacgtagcagcgaagtgggtagaataagtcgcccgagtttaatgggcgaagaggagtacctaaacgattccttgctcagaccggcaagagaaaaaaatttcccaaacaatggaatagaaagtttggtggataaaatgagtagatggaagacttatgctcaggatcacagagacgagcctgggatcatggggactacaagtagagcgagccgtagacgccagcgccatgacagacagaggggtcttgtgtgggacgatgaggattcggccgatgatagcagcgtattggacttgggtgggagaggaaggggcaacccgtttgctcatttgcgccctcgcttgggtggtatgttgtaaaaaaaaataaaaaagaaaaaactcaccaaggccatggcgacgagcgtacgttcgttcttctttattatctgtgtctagtataatgaggcgagtcgtgctaggcggagcggtggtgtatccggagggtcctcctccttcgtacgagagcgtgatgcagcagcagcaggcgacggcggtgatgcaatccccactggaggctccctttgtgcctccgcgatacctggcacctacggagggcagaaacagcattcgttactcggaactggcacctcagtacgataccaccaggttgtatctggtggacaacaagtcggcggacattgcttctctgaactatcagaatgaccacagcaacttcttgaccacggtggtgcaaaacaatgactttacccctacggaagccagcacccagaccattaactttgatgaacgatcgcggtggggcggtcagctaaaaaccatcatgcatactaacatgcccaacgtgaacgagtatatgtttagtaacaagttcaaagcgcgtgtgatggtgtccagaaaacctcctgagggtgttagagtagacgataattatgatcataagcaagatattctaaaatacgagtggttcgagtttactttgccagaaggcaacttttcggtcactatgactatcgacttgatgaacaatgccatcatagacaattacttgaaagtgggcagacagaatggagtgttggaaagtgacattggtgttaagttcgacactaggaacttcaagttgggatgggatccagaaactaagttgatcatgcctggggtttacacctatgaggccttccatcctgacatcgtattgctgcctggctgcggagtggactttaccgaaagccgtctgagcaaccttcttggcattagaaagaaacacccattccaagagggttttaagatcttgtatgaggatttagaaggaggaaatattccagcccttttggatgtagatgcttatgagaacagcaagaaagatcaaaaagccaaaatagaagctgctgcagaagctaaagcaaacatagttgccaacgatccggtaagggtggctaacgctagtgaaatcaggggagacagttttgccgcaacatccgttccgactaaagaatcattattggatgatgtgtctcaaaacatagagttaaaactcactattaagcctgtggaaaaagatggcaaaaacagaagttacaatgtgttggaagataaaatcaacacggcctatcgcagttggtacctttcgtacaattatggcgaccccgaaaaaggagtgcgttcctggacattgctcaccacctcagatgtcacctgcggagcggagcaggtctactggtcgcttccagacatgatgcaggatcctgtcactttccgctccactagacaagtcagtaactaccctgtggtgggtgcagagcttatgcccgtcttttcaaagagcttctacaacgaacaagctgtgtactcccagcagctccgccagtccacctcgcttacgcacgtcttcaaccgctttcctgagaaccagattttaatccgtccgccggcgcccacaattaccaccgtcagtgaaaacgttcctgctctcacagatcacgggaccctgccgttgcgcagcagtatccggggagtccaacgtgtgaccgttactgacgccagacgccgcacctgtccctacgtgtacaaggcactgggcatagtcgcaccgcgcgtcctttcaagccgcactttctaaaaaaaaaaaaaaaatgtccgttcttatctcgcccagtaataacaccggttggggtctgcgcgctcccagcaagatgtacggaggcgcacgcaaacgttctacccaacatcccgtgcgtgttcgcgggcattttcgcgctccatggggtgccctcaagggccgcactcgcgttcgaaccaccgtcgatgatgtaatcgatcaggtggttgccgacgcccgtaattatactcctactgcgcctacatctactgtggacgcagttattgacagtgtagtggctgacgctcgcaactatgctcgacgtaagagccggcgaaggcgcattgccagacgtcaccgagctaccactgccatgcgagcagcaagagctctgctacgaagagctagacgcgtggggcgaagagccatgcttagggcggccagacgtgcagcttcgggcgccagcgccggcaggtcccgcaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggatgtccaagcgcaaatacaaggaagaaatgctgcaggttatcgcacctgaagtctacggccaaccgttgaaggatgaaaaaaaaccccgcaaaatcaagcgggtaaaaaaggacaaaaaagaagaggaagatggcgatgatgggctggcggagtttgtgcgcgagtttgccccacggcgacgcgtgcaatggcgtgggcgcaaagttcgacatgtgttgagacctggaacttcggtggtctttacacccggcgagcgttcaagcgctacttttaagcgttcctatgatgaggtgtacggggatgatgatattcttgagcaggcagctgaccgattaggcgagtttgcttatggcaagcgtagtagaataaatcccaaggatgaaacagtgtccatacccttggatcatggaaatcccacccctagtcttaaaccggtcactttgcagcaagtgttacccgtaactccgcgaacaggtgttaaacgcgaaggtgaagatttgtatcccactatgcaactgatggtgcccaaacgccagaagttggaggacgttttggagaaagtaaaagtggatccagatattcaacctgaggttaaagtgagacccattaagcaggtagcgcctggtctgggagtacaaactgtagacattaaaattcccactgaaagtatggaagtgcaaactgaacccgcaaagcctactgccacctccactgaagtgcaaacggacccatggatgcccatgcctattacaactgacgccgtcggtcccactcgaagatcccgacgaaagtacggtccagcaagtctgttgatgcccaactatgtcgtacacccatctattattcctactcctggttaccgaggcactcgctactatcgcagccgaaacagtacttcccgccgtcgccgcaagacacctgcaaatcgcagtcgtcgccgtagacgcacaagcaaaccgattcccggcgccctggtgcggcaagtgtaccgcaatggtagtgcggaacctttgacactgccgcgtgcgcgttaccatcctagtatcatcacttaatcaatgttgccgctgcctccttgcagatatggccctcacttgtcgccttcgcgttcccatcactggttaccgaggaagaaactcgcgccgtagaagagggatgttggggcgcggaatgcgacgctacaggcgacggcgtgctatccgcaagcaattgcggggtggttttttgccagccttaattccaattatcgctgctgcgattggcgcaataccaggcatagcttccgtggcggttcaggcctcgcaacgacattgacattggaaaaaaaaaaaacgtataaataaaaaatacaatggactctgacactcctggtactgtgactatgttttcttagagatggaagacatcaatttttcatccttggctccgcgacacggcacgaagccgtacatgggcacctggagcgacatcggcacgagccaactgaacgggggcgccttcaattggagcagtatctggagcgggcttaaaaattttggctcaaccataaaaacatacgggaacaaagcttggaacagcagtacaggacaggcgcttagaaataaacttaaagaccagaacttccaacaaaaagtagtcgatgggatagcttccggtatcaatggagtggtagatttggctaaccaggctgtgcagaaaaagataaacagtcgtttggacccgccgccagcaaccccaggtgaaatgcaagtggaggaagaaattcctccgccagaaaaacgaggcgacaagcgtccgcgtcccgatttggaagagacgctggtgacgcgcgtagatgaaccgccttcttatgaggaagcaacgaagcttggaatgcccaccactagaccgatagcccctatggccaccggggtgatgaaaccttctcagttgcatcgacccgtcaccttggatttgccccctcctcctgctgctactgctgtacccgcttctaagcctgtcgctgccccgaaaccagtcgccgtagccaggtcacgtcccgggggcgctcctcgtccaaatgcacactggcaaaatactctgaacagcatcgtgggtctaggcgtgcaaagtgtaaaacgccgtcgctgcttttaattaaatatggagtagcgcttaacttgcctatctgtgtatatgtgtcattacacgccgtcacagcatcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcagttcgcccgcgccacagacacctacttcaatctgggaaataagtttagaaatcctaccgtagcgccgacccacgatgtgaccaccgatcgtagccagcggctcatgttgcgcttcgtgcccgttgaccgggaggacaatacatactcttacaaagtgcggtacaccctggccgtgggcgacaacagagtgctggatatggccagcacgttctttgacattaggggcgtgttggacagaggtcccagttttaaaccctattctggtacggcttacaactccctggctcctaaaggcgctccaaatgcatctcagtggttggataagggagttacaagcactggcctagtggacgacggcaatactgatgatggggaagaagccaaaaaagcaacatacacttttggtaatgctccagtaaaagccgaggctgaaatcacaaaagacggattgccggtgggcttggaagtttcaactgaaggtcctaaaccaatctatgctgataagctttatcagccagaacctcaagtgggagacgaaacttggactgacctagacggaaaaaccgaagagtatggagggagggttcttaaacctgaaactaaaatgaaaccctgctacggatcttttgctaaacctactaatattaaaggaggtcaggcaaaggtaaaaccaaaagaagacgatggcactaacaacatcgagtatgacattgacatgaacttctttgacttaagatcacaaagatcagaactcaaacctaaaattgtaatgtatgcagaaaatgtggacctggaatgtccagatactcatgttgtgtacaaacctggagtttcagatgctagttctgagaccaatcttggacaacagtctatgcccaacagacccaactacattggcttcagagataacttcatcggacttatgtactataacagtactggcaacatgggggtactggctggccaagcgtctcagttgaatgcagtggttgacttgcaggacagaaacacagaactgtcttaccaactcttgcttgactctctgggcgacagaaccagatactttagcatgtggaatcaggctgtggacagttatgatcctgatgtacgtgttattgaaaatcatggtgtggaagatgaacttcccaactattgttttccgttggatggtgtcggtccgcgaacagatagttacaaggagattaagccaaatggagaccaatctacttggacaaatgtagacccaactggcagcagtgaacttgctaagggaaatccatttgccatggaaattaaccttcaagccaatctatggcgaagtttcctttattccaatgtggctctatatctcccagactcgtacaaatacaccccgtccaatgtcactcttccagaaaacaaaaacacctacgactacatgaacgggcgggtggtgccgccatctctagtagacacctatgtgaacattggtgccaggtggtctctggatgccatggacaatgtcaacccattcaaccaccaccgtaacgctggcttgcgttaccgatccatgcttctgggtaacggacgttatgtgcctttccacatacaagtgcctcaaaaattcttcgctgttaaaaacctgctgcttctcccaggctcctacacttatgagtggaactttaggaaggatgtaaacatggttctacagagttccctcggtaacgacctacgggtagatggcgccagcatcagttttacgagcatcaacctctatgctacttttttccccatggctcacaacaccgcttccacccttgaagccatgctgcggaatgacaccaatgatcagtcattcaacgactacctatctgcagctaacatgctctaccccattcctgccaatgcaaccaatattcccatttccattccttctcgcaactgggcggctttcagaggctggtcatttaccagactgaaaaccaaagaaactccctctttggggtctggatttgacccctacttcgtctattctggttctattccctacctggatggtaccttctacctgaaccacacttttaagaaggtttccatcatgtttgactcttcagtgagctggcctggaaatgacaggttactatctcctaacgaatttgaaataaagcgcactgtggatggcgaaggctacaacgtagcccaatgcaacatgaccaaagactggttcttggtacagatgctcgccaactacaacatcggctatcagggcttctacattccagaaggatacaaagatcgcatgtattcatttttcagaaacttccagcccatgagcaggcaggtggttgatgaggtcaattacaaagacttcaaggccgtcgccataccctaccaacacaacaactctggctttgtgggttacatggctccgaccatgcgtcaaggtcaaccctatcccgctaactatccctatccactcattggaacaactgccgtaaatagtgttacgcagaaaaagttcttgtgtgacagaaccatgtggcgcataccgttctcaagcaacttcatgtctatgggagcccttacagacttgggacagaacatgctctatgccaactcagctcatgctctggacatgacctttgaggtggatcccatggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaacagcagctgcaaccatggcctgcggatcccaaaacggctccagcgagcaagagctcagagccattgtccaagacctgggttgcggaccatattttttgggaacctttgataagcgcttcccggggttcatggcccccgataagctcgcctgtgccattgtaaatacggccggacgtgagacggggggagagcactggttggctttcggttggaacccacgttctaacacctgctacctttttgatccttttggattctcggatgatcgtctcaaacagatttaccagtttgaatatgagggtctcctgcgccgcagcgctcttgctaccaaggaccggtgtattacgctggaaaaatctacccagaccgtgcagggcccccgttctgccgcctgcggacttttctgctgcatgttccttcatgcctttgtgcactggcctgaccgtcccatggacggaaaccccaccatgaaattgctaactggagtgccaaacaacatgcttcattctcctaaagtccagcccaccctgtgtgacaatcaaaaagcactctaccattttctcaatacccattcgccttattttcgctctcatcgtacacacatcgaaagggccactgcgttcgaccgtatggatgtgcaataatgattcatgtaaacaacgtgttcaataaacagcactttattttttacatgtatcgaggctctggattacttatttatttacaagtcgaatgggttctgacgagaatcagaatgacccgcaggcagtgatacgttgcggaactgatacttgggttgccacttgaattcgggaatcaccaacttgggaaccggtatatcgggcaggatgtcactccacagctttctggtcagctgcaaagctcccagcaggtcaggagccgaaatcttgaaatcacaattaggaccagtgctctgagcgcgagagttgcggtacaccggattgcagcactgaaacaccatcagcgacggatgtcttacgcttgccagcacggtgggatctgcaatcatgcccacatccagatcttcagcattggcaatgctgaacggggtcatcttgcaggtctgcctacccatggcgggcacccaattaggcttgtggttacaatcgcagtgcagggggatcagtatcatcttggcctgatcctgtctgattcctggatacacggctctcatgaaagcatcatattgcttgaaagcctgctgggctttactaccctcggtataaaacatcccgcaggacctgctcgaaaactggttagctgcgcagccggcatcattcacacagcagcgggcgtcattgttggctatttgcaccacacttctgccccagcggttttgggtgattttggttcgctcgggattctccttcaaggctcgttgtccgttctcgctggccacatccatctcgataatctgctccttctgaatcataatattgccatgcaagcacttcagcttgccctcataatcattgcagccatgaggccacaacgcacagcctgtacattcccaattatggtgggcgatctgagaaaaagaatgtatcattccctgcagaaatcttcccatcatcgtgctcagtgtcttgtgactagtgaaagttaactggatgcctcggtgctcctcgttcacgtactggtgacagatgcgcttgtattgttcgtgctgctcaggcattagtttaaaagaggttctaagttcgttatccagcctgtacttctccatcagcagacacatcacttccatgcctttctcccaagcagacaccaggggcaagctaatcggattcttaacagtgcaggcagcagctcctttagccagagggtcatctttggcgatcttctcaatgcttcttttgccatccttctcaacgatgcgcacgggcgggtagctgaaacccactgctacaagttgcgcctcttctctttcttcttcgctgtcttgactgatgtcttgcatggggacatgtttggtcttccttggcttctttttcgggggtatcggaggaggaggactgtcgctccgttccggagacagggaggattgtgacgtttcgctcaccattaccaactgactgtcggtagaagaacctgaccccacacggcgacaggtgtttctcttcgggggcagaggtggaggcgattgcgaagggctgcggtccgacctggaaggcggatgactggcagaaccccttccgcgttcgggggtgtgctccctgtggcggtcgcttaactgatttccttcgcggctggccattgtgttctcctaggcagagaaacaacagacatggaaactcagccattgctgtcaacatcgccacgagtgccatcacatctcgtcctcagcgacgaggaaaaggagcagagcttaagcattccaccgcccagtcctgccaccacctctaccctagaagataaggaggtcgacgcatctcatgacatgcagaataaaaaagcgaaagagtctgagccagacatcgaacaagacccgggctatgtgacaccggtggaacacgaggaagagttgaaacgctttctagagagagaggatgaaaactgcccaaaacagcaagcggataactatcaccaagatgctggaaatagggatcagaacaccgactacctcatagggcttgacggggaagacgcgctccttaaacatctagcaagacagtcactcatagtcaaggatgcattattggacagaactgaagtgcccatcagtgtcgaagagctcagccgcgcctacgagcttaacctattttcacctcgtactccccccaaacgtcagccaaacggcacctgcgagccaaatcctcgcttaaacttttatccagcttttgctgtgccagaagtactggctacctatcacatcttttttaaaaatcaaaaaattccagtctcctgccgcgctaatcgcacccgcgccgatgccctactcaatctgggacctggttcacgcttacctgatatagcttccttggaagaggttccaaagatcttcgagggtctgggcaataatgagactcgggccgcaaatgctctgcaaaagggagaaaatggcatggatgagcatcacagcgttctggtggaattggaaggcgataatgccagactcgcagtactcaagcgaagcgtcgaggtcacacactttgcataccccgctgtcaacctgccccctaaagtcatgacggccgtcatggaccagttactcattaagcgcgcaagtcccctttcagaagacatgcatgacccagatgcctgtgatgagggtaaaccagtggtcagtgatgagcagctaacccgatggctgggcaccgactctccccgggatttggaagagcgtcgcaagcttatgatggccgtggtgctggttaccgtagaactagagtgtcttcggcgtttctttaccgattcagaaaccttgcgcaaactcgaagagaatctgcactacacttttagacacggctttgtgcggcaggcatgcaagatatctaacgtggaactcaccaacctggtttcctacatgggtattctgcatgagaatcgcctaggacaaagcgtgctgcacagcacccttaagggggaagcccgccgtgattacatccgcgattgtgtttatctctacctgtgccacacgtggcaaaccggcatgggtgtatggcagcaatgtttagaagaacagaacctgaaagagctaaacaagctcttacagaaatctcttaaggttctgtggacagggttcgacgagcgcaccgtcgcttccgacctggcagacctcatcttcccagagcgtctcagggttactttgcgaaacggactgcctgactttatgagccagagcatgcttaacaattttcgctctttcatcctggaacgctccggtatcctgcccgccacctgctgcgcactgccctccgactttgtgcctctcacctaccgcgaatgccccccgccgctatggagtcactgctacctgttccgtctggccaactacctctcctaccactcggatgtgatcgaggatgtgagcggagacggcttgctggagtgtcactgccgctgcaatctgtgcacgccccaccggtccctagcttgcaacccccagttgatgagcgaaacccagataataggcacctttgaattgcaaggccccagcagccaaggcgatgggtcttctcctgggcaaagtttaaaactgaccccgggactgtggacctccgcctacttgcgcaagtttgccccggaagattaccacccctatgaaatcaagttctatgaggaccaatcacagcctccgaaagccgaactttcggcctgcgtcatcacccagggggcaattctggcccaattgcaagccatccaaaaatcccgccaagaatttctactgaaaaagggtaagggggtctaccttgacccccagaccggcgaggaactcaacacaaggttccctcaggatgtcccaacgacgagaaagcaagaagttgaaggtgcagccgccgcccccagaagatatggaggaagattgggacagtcaggcagaggaagcggaggaggaggacagtctggaggacagtctggaggaagacagtttggaggaggaaaacgaggaggcagaggaggtggaagaagtaaccgccgacaaacagttatcctcggctgcggagacaagcaacagcgctaccatctccgctccgagtcgaggaacccggcggcgtcccagcagtagatgggacgagaccggacgcttcccgaacccaaccagcgcttccaagaccggtaagaaggatcggcagggatacaagtcctggcgggggcataagaatgccatcatctcctgcttgcatgagtgcgggggcaacatatccttcacgcggcgctacttgctattccaccatggggtgaactttccgcgcaatgttttgcattactaccgtcacctccacagcccctactatagccagcaaatcccggcagtctcgacagataaagacagcggcggcgacctccaacagaaaaccagcagcggcagttagaaaatacacaacaagtgcagcaacaggaggattaaagattacagccaacgagccagcgcaaacccgagagttaagaaatcggatctttccaaccctgtatgccatcttccagcagagtcggggccaagagcaggaactgaaaataaaaaaccgatctctgcgttcgctcaccagaagttgtttgtatcacaagagcgaagatcaacttcagcgcactctcgaggacgccgaggctctcttcaacaagtactgcgcgctgactcttaaagagtaggcagcgaccgcgcttattcaaaaaaggcgggaattacatcatcctcgacatgagtaaagaaattcccacgccttacatgtggagttatcagccccaaatgggattggcggcaggcgcctcccaggactactccacccgcatgaattggctcagcgccgggccttctatgatttctcgagttaatgatatacgcgcctaccgaaaccaaatacttttggaacagtcagctcttaccaccacgccccgccaacaccttaatcccagaaattggcccgccgccctagtgtaccaggaaagtcccgctcccaccactgtattacttcctcgagacgcccaggccgaagtccaaatgactaatgcaggtgcgcagttagcgggcggctccaccctatgtcgtcacaggcctcggcataatataaaacgcctgatgatcagaggccgaggtatccagctcaacgacgagtcggtgagctctccgcttggtctacgaccagacggaatctttcagattgccggctgcgggagatcttccttcacccctcgtcaggctgttctgactttggaaagttcgtcttcgcaaccccgctcgggcggaatcgggaccgttcaatttgtggaggagtttactccctctgtctacttcaaccccttctccggatctcctgggcactacccggacgagttcataccgaacttcgacgcgattagcgagtcagtggacggctacgattgatgtctggtgacgcggctgagctatctcggctgcgacatctagaccactgccgccgctttcgctgctttgcccgggaactcattgagttcatctacttcgaactccccaaggatcaccctcaaggtccggcccacggagtgcggattactatcgaaggcaaaatacactctcgcctgcaacgaattttctcccagcggcccgtgctgatcgagcgagaccagggaaacaccacggtttccatctactgcatttgtaatcaccccggattgcatgaaagcctttgctgtcttatgtgtactgagtttaataaaaactgaattaagactctcctacggactgccgcttcttcaacccggattttacaaccagaagaacgaaacttttcctgtcgtccaggactctgttaacttcacctttcctactcacaaactagaagctcaacgactacaccgcttttccagaagcattttccctactaatactactttcaaaaccggaggtgagctccaaggtcttcctacagaaaacccttgggtggaagcgggccttgtagtgctaggaattcttgcgggtgggcttgtgattattctttgctacctatacacaccttgcttcactttcctagtggtgttgtggtattggtttaaaaaatggggcccatactagtcttgcttgttttactttcgcttttggaaccgggttctgccaattacgatccatgtctagacttcgacccagaaaactgcacacttacttttgcacccgacacaagccgcatctgtggagttcttattaagtgcggatgggaatgcaggtccgttgaaattacacacaataacaaaacctggaacaataccttatccaccacatgggagccaggagttcccgagtggtacactgtctctgtccgaggtcctgacggttccatccgcattagtaacaacactttcattttttctgaaatgtgcgatctggccatgttcatgagcaaacagtattctctatggcctcctagcaaggacaacatcgtaacgttctccattgcttattgcttgtgcgcttgccttcttactgctttactgtgcgtatgcatacacctgcttgtaaccactcgcatcaaaaacgccaataacaaagaaaaaatgccttaacctctttctgtttacagacatggcttctcttacatctctcatatttgtcagcattgtcactgccgctcacggacaaacagtcgtctctatccctctaggacataattacactctcataggacccccaatcacttcagaggtcatctggaccaaactgggaagcgttgattactttgatataatctgcaacaaaacaaaaccaataatagtaacttgcaacatacaaaatcttacattgattaatgttagcaaagtttacagcggttactattatggttatgacagatacagtagtcaatatagaaattacttggttcgtgttacccagttaaaaaccacgaaaatgccaaatatggcaaagattcgatccgatgacaattctctagaaacttttacatctcccaccacacccgacgaaaaaaacatcccagattcaatgattgcaattgttgcagcggtggcagtggtgatggcactaataataatatgcatgcttttatatgcttgtcgctacaaaaagtttcatcctaaaaaacaagatctcctactaaggcttaacatttaatttctttttatacagccatggtttccactaccacattccttatgcttactagtcttgcaactctgacttctgctcgctcacacctcactgtaactataggctcaaactgcacactaaaaggacctcaaggtggtcatgtcttttggtggagaatatatgacaatggatggtttacaaaaccatgtgaccaacctggtagatttttctgcaacggcagagacctaaccattatcaacgtgacagcaaatgacaaaggcttctattatggaaccgactataaaagtagtttagattataacattattgtactgccatctaccactccagcaccccgcacaactactttctctagcagcagtgtcgctaacaatacaatttccaatccaacctttgccgcgcttttaaaacgcactgtgaataattctacaacttcacatacaacaatttccacttcaacaatcagcattatcgctgcagtgacaattggaatatctattcttgtttttaccataacctactacgcctgctgctatagaaaagacaaacataaaggtgatccattacttagatttgatatttaatttgttctttttttttttatttacagtatggtgaacaccaatcatggtacctagaaatttcttcttcaccatactcatttgtgcatttaatgtttgcgctactttcacagcagtagccacagcaaccccagactgtataggagcatttgcttcctatgcactttttgcttttgttacttgcatctgcgtatgtagcatagtctgcctggttattaattttttccaacttctagactggatccttgtgcgaattgcctacctgcgccaccatcccgaataccgcaaccaaaatatcgcggcacttcttagactcatctaaaaccatgcaggctatactaccaatatttttgcttctattgcttccctacgctgtctcaaccccagctgcctatagtactccaccagaacaccttagaaaatgcaaattccaacaaccgtggtcatttcttgcttgctatcgagaaaaatcagaaattcccccaaatttaataatgattgctggaataattaatataatctgttgcaccataatttcatttttgatataccccctatttgattttggctggaatgctcccaatgcacatgatcatccacaagacccagaggaacacattcccctacaaaacatgcaacatccaatagcgctaatagattacgaaagtgaaccacaacccccactactccctgctattagttacttcaacctaaccggcggagatgactgaaacactcaccacctccaattccgccgaggatctgctcgatatggacggccgcgtctcagaacagcgacttgcccaactacgcatccgccagcagcaggaacgcgcggccaaagagctcagagatgtcatccaaattcaccaatgcaaaaaaggcatattctgtttggtaaaacaagccaagatatcctacgagatcaccgctactgaccatcgcctctcttacgaacttggcccccaacgacaaaaatttacctgcatggtgggaatcaaccccatagttatcacccagcaaagtggagatactaagggttgcattcactgctcctgcgattccatcgagtgcacctacaccctgctgaagaccctatgcggcctaagagacctgctaccaatgaattaaaaaatgattaataaaaaatcacttacttgaaatcagcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagatgaccaagagagtccggctcagtgactccttcaaccctgtctacccctatgaagatgaaagcacctcccaacacccctttataaacccagggtttatttccccaaatggcttcacacaaagcccagacggagttcttactttaaaatgtttaaccccactaacaaccacaggcggatctctacagctaaaagtgggagggggacttacagtggatgacactgatggtaccttacaagaaaacatacgtgctacagcacccattactaaaaataatcactctgtagaactatccattggaaatggattagaaactcaaaacaataaactatgtgccaaattgggaaatgggttaaaatttaacaacggtgacatttgtataaaggatagtattaacaccttatggactggaataaaccctccacctaactgtcaaattgtggaaaacactaatacaaatgatggcaaacttactttagtattagtaaaaaacggagggcttgttaatggctacgtgtctctagttggtgtatcagacactgtgaaccaaatgttcacacaaaagacagcaaacatccaattaagattatattttgactcttctggaaatctattaactgatgaatcagacttaaaaattccacttaaaaataaatcttctacagcgaccagtgaaactgtagccagcagcaaagcctttatgccaagtactacagcttatcccttcaacaccactactagggatagtgaaaactacattcatggaatatgttactacatgactagttatgatagaagtctatttcccttgaacatttctataatgctaaacagccgtatgatttcttccaatgttgcctatgccatacaatttgaatggaatctaaatgcaagtgaatctccagaaagcaacatagctacgctgaccacatccccctttttcttttcttacattacagaagacgacaactaaaataaagtttaagtgtttttatttaaaatcacaaaattcgagtagttattttgcctccaccttcccatttgacagaatacaccaatctctccccacgcacagctttaaacatttggataccattagagatagacattgttttagattccacattccaaacagtttcagagcgagccaatctggggtcagtgatagataaaaatccatcgcgatagtcttttaaagcgctttcacagtccaactgctgcggatgcgaatccggagtctggatcacggtcatctggaagaagaacgatgggaatcataatccgaaaacggtatcggacgattgtgtctcatcaaacccacaagcagccgctgtctgcgtcgctccgtgcaactgctgtttatgggatcagggtccacagtgtcctgaagcatgattttaatagcccttaacatcaactttctggtgcgatgcgcgcagcaacgcattctgatttcactcaaatctttgcagtaggtacaacacattattacaatattgtttaataaaccataattaaaagcgctccagccaaaactcatatctgatataatcgcccctgcatgaccatcataccaaagtttaatataaattaaatgacgttccctcaaaaacacactacccacatacatgatctcttttggcatgtgcatattaacaatctgtctgtaccatggacaacgttggttaatcatgcaacccaatataaccttccggaaccacactgccaacaccgctcccccagccatgcattgaagtgaaccctgctgattacaatgacaatgaagaacccaattctctcgaccgtgaatcacttgagaatgaaaaatatctatagtggcacaacatagacataaatgcatgcatcttctcataatttttaactcctcaggatttagaaacatatcccagggaataggaagctcttgcagaacagtaaagctggcagaacaaggaagaccacgaacacaacttacactatgcatagtcatagtatcacaatctggcaacagcgggtggtcttcagtcatagaagctcgggtttcattttcctcacaacgtggtaactgggctctggtgtaagggtgatgtctggcgcatgatgtcgagcgtgcgcgcaaccttgtcataatggagttgcttcctgacattctcgtattttgtatagcaaaacgcggccctggcagaacacactcttcttcgccttctatcctgccgcttagcgtgttccgtgtgatagttcaagtacagccacactcttaagttggtcaaaagaatgctggcttcagttgtaatcaaaactccatcgcatctaattgttctgaggaaatcatccacggtagcatatgcaaatcccaaccaagcaatgcaactggattgcgtttcaagcaggagaggagagggaagagacggaagaaccatgttaatttttattccaaacgatctcgcagtacttcaaattgtagatcgcgcagatggcatctctcgcccccactgtgttggtgaaaaagcacagctaaatcaaaagaaatgcgattttcaaggtgctcaacggtggcttccaacaaagcctccacgcgcacatccaagaacaaaagaataccaaaagaaggagcattttctaactcctcaatcatcatattacattcctgcaccattcccagataattttcagctttccagccttgaattattcgtgtcagttcttgtggtaaatccaatccacacattacaaacaggtcccggagggcgccctccaccaccattcttaaacacaccctcataatgacaaaatatcttgctcctgtgtcacctgtagcgaattgagaatggcaacatcaattgacatgcccttggctctaagttcttctttaagttctagttgtaaaaactctctcatattatcaccaaactgcttagccagaagccccccgggaacaagagcaggggacgctacagtgcagtacaagcgcagacctccccaattggctccagcaaaaacaagattggaataagcatattgggaaccgccagtaatatcatcgaagttgctggaaatataatcaggcagagtttcttgtaaaaattgaataaaagaaaaatttgccaaaaaaacattcaaaacctctgggatgcaaatgcaataggttaccgcgctgcgctccaacattgttagttttgaattagtctgcaaaaataaaaaaaaaaacaagcgtcatatcatagtagcctgacgaacaggtggataaatcagtctttccatcacaagacaagccacagggtctccagctcgaccctcgtaaaacctgtcatggtgattaaacaacagcaccgaaagttcctcgcggtgaccagcatgaataattcttgatgaagcatacaatccagacatgttagcatcagttaacgagaaaaaacagccaacatagcctttgggtataattatgcttaatcgtaagtatagcaaagccacccctcgcggatacaaagtaaaaggcacaggagaataaaaaatataattatttctctgctgctgttcaggcaacgtcgcccccggtccctctaaatacacatacaaagcctcatcagccatggcttaccagacaaagtacagcgggcacgcacaagctctaaagtcactctccaacctctccacaatatatatacacaagccctaaactgacgtaatgggagtaaagtgtaaaaaatcccgccaaacccaacacacaccccgaaactgcgtcaccagggaaaagtacagtttcacttccgcaatcccaacaagcgtcacttcctctttctcacggtacgtcacatcccattaacttgcaacgtcattttcccacggccgcgccgccccgtttagccgttaaccccacagccaatcaccacacaccccacaatttttaaaatcacctcatttacatattggcaccattccatctataaggtatattattgatgatg

SEQ ID NO: 144 - DNA, 23 bp, Artificial Sequence
  Synthetic polynucleotide
caacttttctatacaaagttgta

SEQ ID NO: 145 - DNA, 21 bp, Artificial Sequence
  Synthetic polynucleotide
caactttttaatacaaagttg

SEQ ID NO: 146 - DNA, 24 bp, Artificial Sequence
  Synthetic polypeptide
tcaactttgtatacaaaagttgtg

SEQ ID NO: 147 - DNA, 51 bp, Artificial Sequence
  Synthetic polynucleotide
acaactttgtataataaagttgctgaatcgtttgtgttatgtttcaacgtg

SEQ ID NO: 148 - protein, 52 aa, Artificial Sequence
  Synthetic polypeptide
  VARIANT (2)..(2): Residue is N or K
  VARIANT (29)..(29): Residue is E, S, A, D, L, G or H
  VARIANT (38)..(38): Residue is D, R, E, Q, N, V, F or K
  VARIANT (40)..(40): Residue is E or absent
  VARIANT (41)..(41): Residue is I, V, Q, N, T, S, E, D, K, L, P, A or C
NXRYPSQIASFVLAWTRAFVSEWAEFLYXEDRGTPLEXRXXLKSVYGDTDSL

SEQ ID NO: 149 - protein, 44 aa, Artificial Sequence
  Synthetic polypeptide
  VARIANT (5)..(5): Residue is R, E, A, G, K, T or S
  VARIANT (24)..(24): Residue is N, K, S, R, P, A or Q
  VARIANT (30)..(30): Residue is E, A, Q, K, N, D, T, H or C
  VARIANT (31)..(31): Residue is R, N, H, D, K, S, E, G, C or A
  VARIANT (33)..(33): Residue is E, D, Q, S, D, N, C, A or K
  VARIANT (43)..(43): Residue is K, Q, W, E, S, V or R
FVIEXGHRLMETRGKHRIKKNGGXLVFDPXXPXLTWLVECETXC

SEQ ID NO: 150 - protein, 45 aa, Artificial Sequence
  Synthetic polypeptide
  VARIANT (1)..(1): Residue is E, N, P, K, A, S, D or G
  VARIANT (2)..(2): Residue is K, L, V, N, A, R, S, E or Q
  VARIANT (24)..(24): Residue is D, N, E, K, R, S or C
  VARIANT (26)..(26): Residue is T, V, F, I, K, Y, L or H
  VARIANT (28)..(28): Residue is P, V, T, N, L, E, Q, S or N
  VARIANT (29)..(29): Residue is N, D or absent
  VARIANT (30)..(30): Residue is E, P or absent
  VARIANT (31)..(31): Residue is E, K, S, R, T, Q, N, H, V or C
  VARIANT (33)..(33): Residue is Q, H, G, K, N, R or D
  VARIANT (37)..(37): Residue is K, T, G, E, P, S, A or F
XXCGSDAYSSESVFLAPKLYALKXIXCXXXXCXHVGXGKLRAKGH

SEQ ID NO: 151 - protein, 57 aa, Artificial Sequence
  Synthetic polypeptide
  VARIANT (2)..(2): Residue is E, A, D, N, G, S, F or Q
  VARIANT (10)..(10): Residue is V, L, A, P, Y, I, N, H or S
  VARIANT (11)..(11): Residue is S, Q, N, A, G, T, P or V
  VARIANT (57)..(57): Residue is D, R, S, K, E, Q, H, N or P
YXYMNGRLPXXNLVDTFVNIGARWSLDVMDNVNPFNPHRNAGLRYRSQLLGNGRYCX

SEQ ID NO: 152 - protein, 55 aa, Artificial Sequence
  Synthetic polypeptide
  VARIANT (21)..(21): Residue is A or absent
  VARIANT (28)..(28): Residue is S, Y, F, W, V or N
  VARIANT (53)..(53): Residue is N, T, K, I, E, Q, V, R or S
  VARIANT (55)..(55): Residue is T, E, Q, D, H, S, N or A
FHIQVPQKFFAIKNLLLLPGXTYTYEWXFRKDVNMILQSTLGNDLRVDGASIXYX

SEQ ID NO: 153 - protein, 55 aa, Artificial Sequence
  Synthetic polypeptide
  VARIANT (33)..(33): Residue is N, T, A, I, L, S, M or Y
SVNLYASFFPMAHNTASTLEAMLRNDTNDQSFXDYLSAANMLYPIPANATNVPIS

SEQ ID NO: 154 - protein, 81 aa, Artificial Sequence
  Synthetic polypeptide
  VARIANT (19)..(19): Residue is Q, H, A, V or T
  VARIANT (28)..(28): Residue is P, A, T, V, Q or G
  VARIANT (58)..(58): Residue is Q, M, L, T, N or K
  VARIANT (64)..(64): Residue is T, S, A, Q, P or L
IPSRNWAAFRGWSFTRLKXKETPALGSXYDPYFTYSGSIPYLDGTFYLSHTFRRVSIXFDSSVXWPGNDRLLTPNEFEIKR

SEQ ID NO: 155 - protein, 38 aa, Artificial Sequence
  Synthetic polypeptide
  VARIANT (12)..(12): Residue is S, T, K, E, Q, A, G or N
  VARIANT (21)..(21): Residue is V, A, E, R, S, P, Q, G, H or K
  VARIANT (22)..(22): Residue is Q, K, E, D, G, T or S
  VARIANT (23)..(23): Residue is D, M, T, S, Q, N, A, G, E, L or H
  VARIANT (25)..(25): Residue is N, S, D, E, R, H, T, Q or I
  VARIANT (27)..(27): Residue is R, D, C or absent
  VARIANT (28)..(28): Residue is P, G, I or absent
  VARIANT (29)..(29): Residue is A, P, Q, K or absent
  VARIANT (30)..(30): Residue is V, D, M, T, K or S
  VARIANT (36)..(36): Residue is T, M, K, R, Q, E, H, N, D or C
  VARIANT (38)..(38): Residue is N or absent
LGRQLCKMTPFXLSGAEDIDXXXVXDXXXXMLASVXHX

SEQ ID NO: 156 - protein, 41 aa, Artificial Sequence
  Synthetic polypeptide
  VARIANT (15)..(15): Residue is L, S, K, R, N, H, G or Q
  VARIANT (19)..(19): Residue is N, T, G, K, A, Q, S or absent
  VARIANT (20)..(20): Residue is P, G or absent
  VARIANT (21)..(21): Residue is T, G or absent
  VARIANT (22)..(22): Residue is S or absent
  VARIANT (23)..(23): Residue is R or absent
  VARIANT (24)..(24): Residue is R, S, D or absent
  VARIANT (25)..(25): Residue is G, K, A or absent
  VARIANT (26)..(26): Residue is L, R, D, K or absent
  VARIANT (27)..(27): Residue is K, N, V, A, T or absent
  VARIANT (28)..(28): Residue is K, T, Q, A, V, N, S, P or absent
  VARIANT (29)..(29): Residue is T, S, I, A, G, Q or absent
  VARIANT (30)..(30): Residue is E, D, H, A, G or absent
  VARIANT (40)..(40): Residue is P, A, M, I, V or absent
PAVLVFQCCNPVYRXSRAXXXXXXXXXXXXKNCDFKISAXD

SEQ ID NO: 157 - protein, 38 aa, Artificial Sequence
  Synthetic polypeptide
  VARIANT (14)..(14): Residue is T, Y, H, K, I, R, V, Q, L or absent
  VARIANT (34)..(34): Residue is E, S, Q, N, T, Y, R, D, A or H
PTPYMWSYQPQTGXAAGASQDYSTRINWLSAGPXMISR

SEQ ID NO: 158 - DNA, 21 bp, Artificial Sequence
  Synthetic polynucleotide
caactttgtacaaaaaagctg

SEQ ID NO: 159 - DNA, 21 bp, Artificial Sequence
  Synthetic polynucleotide
caactttgtacaagaaagctg

SEQ ID NO: 160 - DNA, 21 bp, Artificial Sequence
  Synthetic polynucleotide
caactttgtataataaagttg

SEQ ID NO: 161 - DNA, 21 bp, Artificial Sequence
  Synthetic polynucleotide
caactttgtatagaaaagttg

SEQ ID NO: 162 - DNA, 21 bp, Artificial Sequence
  Synthetic polynucleotide
caactttgtatacaaaagttg

SEQ ID NO: 163 - DNA, 21 bp, Artificial Sequence
  Synthetic polynucleotide
caactttgtattaaaaagttg

SEQ ID NO: 164 - DNA, 105 bp, Artificial Sequence
  Synthetic polynucleotide
  misc_feature (3)..(3): Residue is G, A or T
  misc_feature (4)..(4): Residue is G, A or T
  misc_feature (6)..(6): Residue is A or absent
  misc_feature (7)..(7): Residue is A or absent
  misc_feature (8)..(8): Residue is T or absent
  misc_feature (9)..(9): Residue is T, C or absent
  misc_feature (10)..(10): Residue is A, C or absent
  misc_feature (11)..(11): Residue is A, C, T or absent
  misc_feature (28)..(28): Residue is C, T, G or A
  misc_feature (33)..(33): Residue is T, A or absent
  misc_feature (34)..(34): Residue is C, A or absent
  misc_feature (35)..(35): Residue is T, G or absent
  misc_feature (36)..(36): Residue is G, C or absent
  misc_feature (37)..(37): Residue is T or absent
  misc_feature (38)..(38): Residue is T or absent
  misc_feature (39)..(39): Residue is G or absent
  misc_feature (47)..(47): Residue is G, T or A
  misc_feature (53)..(53): Residue is G, T, A or absent
  misc_feature (54)..(54): Residue is G, T, A or absent
  misc_feature (55)..(55): Residue is C, A, G or absent
  misc_feature (56)..(56): Residue is C, A, G or T
  misc_feature (61)..(61): Residue is T, A, C or absent
  misc_feature (62)..(62): Residue is G, A, C or absent
  misc_feature (63)..(63): Residue is T, A or absent
  misc_feature (64)..(64): Residue is T, A or absent
  misc_feature (65)..(65): Residue is G or absent
  misc_feature (66)..(66): Residue is C or absent
  misc_feature (67)..(67): Residue is T or absent
  misc_feature (68)..(68): Residue is G or absent
  misc_feature (78)..(78): Residue is A or absent
  misc_feature (79)..(79): Residue is T or absent
  misc_feature (80)..(80): Residue is A or absent
  misc_feature (81)..(81): Residue is C, T or absent
  misc_feature (82)..(82): Residue is G, T or absent
  misc_feature (83)..(83): Residue is G, T or absent
  misc_feature (85)..(85): Residue is G, T or A
  misc_feature (96)..(96): Residue is G, A or absent
aannannnnnntaaatcaataaaaaaanaaacnnnnnnnttgatttnaaaaannnnaatgnnnnnnnntctttatttnnnnnngntttttcgcgcncggtaggcc

SEQ ID NO: 165 - DNA, 110 bp, Artificial Sequence
  Synthetic polynucleotide
  misc_feature (2)..(2): Residue is T, C, A or absent
  misc_feature (4)..(4): Residue is G, C, A or absent
  misc_feature (6)..(6): Residue is C, A or absent
  misc_feature (7)..(7): Residue is A, G or absent
  misc_feature (13)..(13): Residue is A, G, C, T or absent
  misc_feature (14)..(14): Residue is A, G or absent
  misc_feature (15)..(15): Residue is A, C, T or absent
  misc_feature (17)..(17): Residue is A, T or absent
  misc_feature (18)..(18): Residue is A or absent
  misc_feature (20)..(20): Residue is G, T or absent
  misc_feature (23)..(23): Residue is T, A, G or C
  misc_feature (29)..(29): Residue is A, T, G or absent
  misc_feature (30)..(30): Residue is A, T, C or absent
  misc_feature (35)..(35): Residue is A, T or absent
  misc_feature (36)..(36): Residue is A or absent
  misc_feature (40)..(40): Residue is A, T, C or absent
  misc_feature (41)..(41): Residue is A, T, C or G
  misc_feature (43)..(43): Residue is C, A or G
  misc_feature (45)..(45): Residue is A, C or T
  misc_feature (57)..(57): Residue is A, T or G
  misc_feature (60)..(60): Residue is C or absent
  misc_feature (61)..(61): Residue is G or absent
  misc_feature (79)..(79): Residue is G, T or absent
  misc_feature (84)..(84): Residue is C, G, T, A or absent
  misc_feature (85)..(85): Residue is T, C, G or absent
  misc_feature (86)..(86): Residue is A or absent
  misc_feature (87)..(87): Residue is G or absent
  misc_feature (88)..(88): Residue is A or absent
  misc_feature (89)..(89): Residue is C or absent
  misc_feature (94)..(94): Residue is C or absent
  misc_feature (95)..(95): Residue is A or absent
  misc_feature (96)..(96): Residue is G or absent
antnannttgcannnanncntgnaaatannaaaannaaannanantggactctgacnctnncctggtcctgtgactatnttttnnnnnntagannnatggaagacatcaa

SEQ ID NO: 166 - DNA, 117 bp, Artificial Sequence
  Synthetic polynucleotide
  misc_feature (12)..(12): Residue is G A, C or T
  misc_feature (13)..(13): Residue is G A, C or T
  misc_feature (14)..(14): Residue is A, C, T or absent
  misc_feature (15)..(15): Residue is A, G, T or absent
  misc_feature (25)..(25): Residue is T, G, C or absent
  misc_feature (26)..(26): Residue is T, C or absent
  misc_feature (27)..(27): Residue is G, A, T or absent
  misc_feature (28)..(28): Residue is G, C or absent
  misc_feature (30)..(30): Residue is T, C, G or A
  misc_feature (32)..(32): Residue is T, C or A
  misc_feature (33)..(33): Residue is A, T, G or absent
  misc_feature (34)..(34): Residue is A, C, G or absent
  misc_feature (45)..(45): Residue is A, G or absent
  misc_feature (46)..(46): Residue is A or absent
  misc_feature (47)..(47): Residue is A or absent
  misc_feature (58)..(58): Residue is T, C or absent
  misc_feature (60)..(60): Residue is C, G, T or absent
  misc_feature (61)..(61): Residue is C or absent
  misc_feature (62)..(62): Residue is C or absent
  misc_feature (63)..(63): Residue is A or absent
  misc_feature (64)..(64): Residue is G, T or absent
  misc_feature (65)..(65): Residue is C or absent
  misc_feature (66)..(66): Residue is G or absent
  misc_feature (67)..(67): Residue is T, G or absent
  misc_feature (68)..(68): Residue is G, C, T or absent
  misc_feature (69)..(69): Residue is G, C or absent
  misc_feature (70)..(70): Residue is T, A, C or G
  misc_feature (75)..(75): Residue is C, T or absent
  misc_feature (76)..(76): Residue is G or absent
  misc_feature (77)..(77): Residue is G, T or absent
  misc_feature (78)..(78): Residue is C or absent
  misc_feature (79)..(79): Residue is G or absent
  misc_feature (80)..(80): Residue is C or absent
  misc_feature (81)..(81): Residue is C or absent
  misc_feature (82)..(82): Residue is A or absent
  misc_feature (83)..(83): Residue is G or absent
  misc_feature (84)..(84): Residue is C or absent
  misc_feature (85)..(85): Residue is A or absent
  misc_feature (86)..(86): Residue is C or absent
  misc_feature (87)..(87): Residue is C or absent
  misc_feature (88)..(88): Residue is T or absent
  misc_feature (89)..(89): Residue is G or absent
  misc_feature (90)..(90): Residue is T, C or absent
  misc_feature (91)..(91): Residue is C or absent
  misc_feature (92)..(92): Residue is G, T or absent
  misc_feature (93)..(93): Residue is T or absent
  misc_feature (94)..(94): Residue is C, T or absent
  misc_feature (95)..(95): Residue is A, G or absent
  misc_feature (96)..(96): Residue is G, C or absent
  misc_feature (97)..(97): Residue is C or absent
  misc_feature (98)..(98): Residue is A, G, C or absent
  misc_feature (99)..(99): Residue is C, T or absent
  misc_feature (100)..(100): Residue is C, A or absent
  misc_feature (101)..(101): Residue is G, A or absent
  misc_feature (102)..(102): Residue is C, T or absent
  misc_feature (103)..(103): Residue is C, T or absent
ttaaagagtagnnnncgcccgcgcnnnnantnnnaaaaggcgggnnnaattacgtcancnnnnnnnnnnncaccnnnnnnnnnnnnnnnnnnnnnnnnnnnnnatgagtaaagaaat

SEQ ID NO: 167 - DNA, 215 bp, Artificial Sequence
  Synthetic polynucleotide
  misc_feature (1)..(1): Residue is T, A, C or absent
  misc_feature (6)..(6): Residue is C, G, A or absent
  misc_feature (10)..(10): Residue is G, T or absent
  misc_feature (11)..(11): Residue is G, A or absent
  misc_feature (12)..(12): Residue is G, A or absent
  misc_feature (14)..(14): Residue is A, T or absent
  misc_feature (18)..(18): Residue is A, C, T or absent
  misc_feature (19)..(19): Residue is A, C, T or absent
  misc_feature (20)..(20): Residue is T, A, G or absent
  misc_feature (21)..(21): Residue is T, A, G or absent
  misc_feature (22)..(22): Residue is T, A, G or absent
  misc_feature (24)..(24): Residue is T, A, G, C or absent
  misc_feature (26)..(26): Residue is G, A or absent
  misc_feature (27)..(27): Residue is A, C, T or absent
  misc_feature (31)..(31): Residue is C, T or absent
  misc_feature (32)..(32): Residue is A, G, T or absent
  misc_feature (33)..(33): Residue is A, G, C, T or absent
  misc_feature (35)..(35): Residue is A, G, C, T or absent
  misc_feature (36)..(36): Residue is T, C, A or absent
  misc_feature (37)..(37): Residue is G, T, C, A or absent
  misc_feature (38)..(38): Residue is T, A or absent
  misc_feature (39)..(39): Residue is A, C, G or absent
  misc_feature (43)..(43): Residue is A, C, G or T
  misc_feature (48)..(48): Residue is A, C or G
  misc_feature (52)..(52): Residue is T, C or G
  misc_feature (59)..(59): Residue is G, C or T
  misc_feature (62)..(62): Residue is C, G, T or absent
  misc_feature (63)..(63): Residue is A, T or absent
  misc_feature (64)..(64): Residue is C or absent
  misc_feature (65)..(65): Residue is A, C or absent
  misc_feature (66)..(66): Residue is G, C or absent
  misc_feature (67)..(67): Residue is G, A or absent
  misc_feature (68)..(68): Residue is A or absent
  misc_feature (70)..(70): Residue is A, T, C or absent
  misc_feature (78)..(78): Residue is A, T, C or G
  misc_feature (81)..(81): Residue is G, A, T or absent
  misc_feature (82)..(82): Residue is T, A, C or absent
  misc_feature (83)..(83): Residue is G, T or absent
  misc_feature (87)..(87): Residue is A, C, G or T
  misc_feature (89)..(89): Residue is C, T, G or absent
  misc_feature (91)..(91): Residue is A, C, T, G or absent
  misc_feature (92)..(92): Residue is A, C, T or absent
  misc_feature (93)..(93): Residue is G, C, T or absent
  misc_feature (95)..(95): Residue is G, T or absent
  misc_feature (97)..(97): Residue is A, G, T or absent
  misc_feature (104)..(104): Residue is A, G, T or C
  misc_feature (107)..(107): Residue is A, G, T or C
  misc_feature (114)..(114): Residue is C or absent
  misc_feature (115)..(115): Residue is A or absent
  misc_feature (116)..(116): Residue is A or absent
  misc_feature (119)..(119): Residue is C, T, G or absent
  misc_feature (120)..(120): Residue is A, C or absent
  misc_feature (121)..(121): Residue is T, A, C or absent
  misc_feature (126)..(126): Residue is T, A or C
  misc_feature (129)..(129): Residue is T, A or G
  misc_feature (132)..(132): Residue is G, A or absent
  misc_feature (133)..(133): Residue is C, G or absent
  misc_feature (134)..(134): Residue is C, T or absent
  misc_feature (135)..(135): Residue is A, C or absent
  misc_feature (136)..(136): Residue is A or absent
  misc_feature (137)..(137): Residue is T or absent
  misc_feature (138)..(138): Residue is T or absent
  misc_feature (139)..(139): Residue is A, T, C, G or absent
  misc_feature (142)..(142): Residue is C, T or G
  misc_feature (145)..(145): Residue is C, A, T or absent
  misc_feature (147)..(147): Residue is A, T, G, C or absent
  misc_feature (148)..(148): Residue is A, T, G, C or absent
  misc_feature (149)..(149): Residue is G, A, T or absent
  misc_feature (152)..(152): Residue is A, T, G, C or absent
  misc_feature (154)..(154): Residue is A, T, G, C or absent
  misc_feature (158)..(158): Residue is A, T, C or absent
  misc_feature (159)..(159): Residue is A, T, G, C or absent
  misc_feature (166)..(166): Residue is A, T or C
  misc_feature (168)..(168): Residue is A, T or C
  misc_feature (171)..(171): Residue is A, T or G
  misc_feature (173)..(173): Residue is A, T, C or absent
  misc_feature (174)..(174): Residue is A, T or absent
  misc_feature (186)..(186): Residue is A, T, G, C or absent
  misc_feature (188)..(188): Residue is A, T, G, C or absent
  misc_feature (189)..(189): Residue is A, T, C or absent
  misc_feature (192)..(192): Residue is C, T, A or absent
  misc_feature (195)..(195): Residue is G, A or absent
  misc_feature (196)..(196): Residue is A or absent
  misc_feature (197)..(197): Residue is T or absent
  misc_feature (198)..(198): Residue is C or absent
  misc_feature (199)..(199): Residue is A or absent
  misc_feature (200)..(200): Residue is C, A or absent
  misc_feature (201)..(201): Residue is T, A or absent
  misc_feature (208)..(208): Residue is A, C, G or absent
  misc_feature (212)..(212): Residue is A, C, T or absent
ntaacnaaannncnatannnnngnannattnnnannnnnttcntatancttngtcctanaannnnnnngntgcccaanaannntaancntnnncntncaacccnatncaccttnnnttnnnttacnttntannnnnnnnttnatnannnaananaacnnaaaaatnangtntnntttgtttatttnannatnttnnnnnnnttcacanaatncga

SEQ ID NO: 168 - DNA, 99 bp, Human adenovirus 5
gcggtttaaaacataaataaaaaaccagactctgtttggatttggatcaagcaagtgtcttgctgtctttatttaggggttttgcgcgcgcggtaggcc

SEQ ID NO: 169 - DNA, 91 bp, Human adenovirus 11
aaaaaaatcccagaatcaatgaataaataaacaagcttgttgttgatttaaaatcaagtgtttttatttcatttttcgcgcacggtatgcc

SEQ ID NO: 170 - DNA, 82 bp, Human adenovirus 7
aaagatctcaaatcaataaataaagaaatacttgttataaaaacaaatgaatgtttatttgatttttcgcgcgcggtatgcc

SEQ ID NO: 171 - DNA, 90 bp, Human adenovirus 4
aaaaaatgaatcaataaataaacggagacggttgttgattttaaaaatcagagtctgaatctttatttgatttttcgcgcacggtaggcc

SEQ ID NO: 172 - DNA, 84 bp, Human adenovirus 12
cctgtaacccaataaagaaaaaacttaaattgagatggtgttatgaatctttattgatacttgttttttctgacatggtaagct

SEQ ID NO: 173 - DNA, 80 bp, Human adenovirus 17
aataaatgattcaataaacacatattctgattcaaacagcaaagcatctttattatttattttttcgcgcgcggtaggcc

SEQ ID NO: 174 - DNA, 73 bp, Human adenovirus 41
gcttcttaaataaataaaagacacaactgtttgaaaagtcaagagtgtttatttgtttcttttgcggtaggcc

SEQ ID NO: 175 - DNA, 102 bp, Human adenovirus 11
attgacattggaaaaaaacgtataaataaaaaaaaaaaatacaaatggactctgacactcctggtcctgtgactatgttttcttagagatggaagacatcaa

SEQ ID NO: 176 - DNA, 94 bp, Human adenovirus 12
ttgcaggcttctcgaaaaaattaaaataaaataaaacttccaacttattactggtactatgactgttttatgcagactaaatggaagacatcaa

SEQ ID NO: 177 - DNA, 74 bp, Human adenovirus 17
gttgatgtgcgaataaagcctctttagactctgacacacctggtcctgtatatttttagaatggaagacatcaa

SEQ ID NO: 178 - DNA, 95 bp, Human adenovirus 4
actgagacacacacttggaaattgtaataaacccgaatggactctgacgctcctggtcctgtgatgtgtttttgtagacagatggaagacatcaa

SEQ ID NO: 179 - DNA, 86 bp, Human adenovirus 41
ttgcaagcacgcaaacaataaaagaagcttgacactgactccctggtcctgactattttatacagacaagacatggaagacatcaa

SEQ ID NO: 180 - DNA, 92 bp, Human adenovirus 5
aaacaagttgcatgtggaaaaatcaaaataaaaagtctggactctcacgctcgcttggtcctgtaactattttgtagaatggaagacatcaa

SEQ ID NO: 181 - DNA, 93 bp, Human adenovirus 7
actaacattggaaaaacttataaataaaaaatagaatggactctgacgctcctggtcctgtgactatgtttttgtagagatggaagacatcaa

SEQ ID NO: 182 - DNA, 80 bp, Human adenovirus 11
ttaaagagtaggcagcgaccgcgcttattcaaaaaaggcgggaattacatcatcctcgacatgagtaaagaaattcccac

SEQ ID NO: 183 - DNA, 84 bp, Human adenovirus 12
ttaaagagtaaaaaaagcccgcgcgcggactttcaacaggcgggaaaagtgacgtcacaacaagatgagtaaagatattcccac

SEQ ID NO: 184 - DNA, 76 bp, Human adenovirus 17
ttaaacactaaggcgcgcccacccggaaaaaaggcgggaattacctcatcgccaccatgagcaaggagattcccac

SEQ ID NO: 185 - DNA, 99 bp, Human adenovirus 4
ttaaagagtagcccgcgcccgcccacacacggaaaaaggcgggaattacgtcacctgtgcacccccacccagcaccgctatgagcaaagaaattcccac

SEQ ID NO: 186 - DNA, 71 bp, Human adenovirus 41
ttaaggactgaaaagcccgcgcttttttaagaaccagattgcgtcatcaccatgagtaaggaaattcccac

SEQ ID NO: 187 - DNA, 118 bp, Human adenovirus 5
ttaaggactagtttcgcgccctttctcaaatttaagcgcgaaaactacgtcatctccagcggccacacccggcgccagcacctgtcgtcagcgccattatgagcaaggaaattcccac

SEQ ID NO: 188 - DNA, 100 bp, Human adenovirus 7
ttaaagagtagcccttgcccgcgcttattcgaaaacggcgggaatcacgtcacccttggcacctgtcctttgccctagtcatgagtaaagagattcccac

SEQ ID NO: 189 - DNA, 197 bp, Human adenovirus 11
ttaaccgaagagcaataaatgacgagacatcatattgtattcgtataacttcgtcctggaacacaggagatgccccagaggtgcaaacctctgctacaaccctagtcacctccccatttaccttttactacatcagagaagacgactgacaaataaagtttaacttgtttatttgaaaatcaattcacaaaatccga

SEQ ID NO: 190 - DNA, 148 bp, Human adenovirus 12
ttcatgtggtcaggtctatcaaactatataaatcagcctttctctacaccatcctgctccttttcttacattacccaagaataaaaacacacacaaaacacaaattgcgtacttattgtttatttttttttttttttacactatacgc

SEQ ID NO: 191 - DNA, 134 bp, Human adenovirus 17
ataaagaatatgccagggttgaatttgaaaccacttcctttaccttctcctatattgcccaacaataaaagaccaataaacgtgttttttatttcaaattttatgtatctttattgatttttacaccagcgcga

SEQ ID NO: 192 - DNA, 179 bp, Human adenovirus 4
ctaacggaagctatatcggagcaacatttggagctaactcatacaccttctcctacatagcccaacaataatcccaccctgcatgccaacccaccttttccctctatttataaatggaaactgaaacaaaaataaagttcaagtgttttattgattcaacagtttttcacaggattcga

SEQ ID NO: 193 - DNA, 203 bp, Human adenovirus 41
tttgcaaggtgatcctaacatggccatatcctttcagagtatttataatcatgcattagaaggctactcattaaaatttacctggcgcgttcgaaataatgaacgttttgacatcccctgctgctcattttcttatgtaacagaacaataaaatattgttgtttttgtttttataactttattgatacttttacagaattcta

SEQ ID NO: 194 - DNA, 210 bp, Human adenovirus 5
ctggccacaactacattaatgaaatatttgccacatcctcttacactttttcatacattgcccaagaataaagaatcgtttgtgttatgtttcaacgtgtttatttttcaattgcagaaaatttcaagtcatttttcattcagtagtatagccccaccaccacatagcttatacagatcaccgtaccttaatcaaactcacagaacccta

SEQ ID NO: 195 - DNA, 196 bp, Human adenovirus 7
ttaaccaaagagcattaaataatgagacatcatattgtattcgtgtaacttggtcctggaatacaggagttgccccagaagtgcaaacctctgctactaccctagtcacctctccatttaccttttactacattagagaagacgactgacaaataaagtttaacttgtttatttaaaatcaattcataaaattcga

The invention claimed is:

1. A method of making a recombinant adenovirus, comprising:
    (i) assembling an adenoviral core module destination vector by combining a hybridization competent vector backbone with one or more hybridization competent adenoviral gene modules by sequence and ligation independent cloning (SLIC), wherein the one or more hybridization competent adenoviral gene modules form a core module that is at least 12 kb in length and the gene modules are selected from the group consisting of an E2-L2 module, an L3-L4 module, both an E2-L2 module and an L3-L4 module, and an E2-L4 module, wherein the E2-L2 module comprises adenovirus E2B, L1 and L2 regions, the L3-L4 module comprises adenovirus L3, E2A and L4 regions, and the E2-L4 module comprises adenovirus E2B, L1, L2, L3, E2A and L4 regions;
    (ii) contacting the adenoviral core module destination vector with an endonuclease to form a linear core module destination vector;
    (iii) contacting the linear core module destination vector with an exonuclease to form a hybridization competent core module destination vector, wherein the hybridization competent core module destination vector comprises a mammalian I-SceI expression cassette; and
    (iv) assembling an adenovirus genome that is at least 24 k kb in length by contacting the hybridization competent core module destination vector with one or more hybridization competent gene modules, wherein the one or more hybridization competent adenoviral gene modules are selected from the group consisting of an E1 module, an E3 module, and an E4 module, and wherein the E1 module comprises an adenovirus E1A region, an adenovirus E1B region, or both adenovirus E1A and E1B regions, the E3 module comprises adenovirus E3 and L5 regions, and the E4 module comprises an adenovirus E4 region, thereby making a recombinant adenovirus.

2. The method of claim 1, wherein the hybridization competent core module destination vector comprises a p15A origin of replication.

3. The method of claim 1, wherein the core module is at least 14 kb in length.

4. The method of claim 1, wherein the core module consists of an E2-L2 module and an L3-L4 module.

5. The method of claim 1, wherein the core module consists of an E2-L4 module.

6. The method of claim 1, wherein the hybridization competent core module destination vector and the one or more hybridization competent adenoviral gene modules comprise a single-stranded nucleic acid overhang of about 20 to about 25 bases in length.

7. The method of claim 6, wherein the hybridization competent core module destination vector and the one or more hybridization competent adenoviral gene modules comprise a single-stranded nucleic acid overhang on each terminus.

8. The method of claim 1, further comprising generating the one or more hybridization competent adenoviral gene modules of step (i) or step (iv), or both step (i) and step (iv), by:
  contacting circular adenoviral gene modules or adenoviral gene modules contained within a circular plasmid with an endonuclease, thereby forming linear adenoviral gene modules; and
  contacting the linear adenoviral gene modules with an exonuclease, thereby forming the one or more hybridization competent adenoviral gene modules.

9. The method of claim 1, further comprising transfecting the adenovirus genome into a cell.

10. The method of claim 1, wherein the adenovirus genome is capable of forming a recombinant adenovirus when expressed in a cell.

11. The method of claim 1, wherein the adenovirus genome is a partial adenovirus genome construct that is capable of forming a recombinant adenovirus when expressed in a complementing cell line or when expressed in a cell with a helper virus.

12. The method of claim 1, wherein at least one of the one or more hybridization competent adenoviral gene modules comprises one or more modifications relative to the wild type adenovirus from which the gene module is derived.

13. The method of claim 1, wherein the adenovirus genome is at least 28 kb.

14. The method of claim 1, wherein the adenovirus genome is at least 32 kb.

15. The method of claim 1, wherein the adenovirus genome is at least 36 kb.

* * * * *

UNITED STATES PATENT AND TRADEMARK OFFICE
CERTIFICATE OF CORRECTION

PATENT NO. : 10,577,589 B2
APPLICATION NO. : 14/935866
DATED : March 3, 2020
INVENTOR(S) : O'Shea et al.

Page 1 of 1

It is certified that error appears in the above-identified patent and that said Letters Patent is hereby corrected as shown below:

In the Claims

Column 54, Lines 53-54, Claim 1, "24 k kb" should read –24 kb–

Signed and Sealed this
Eighth Day of August, 2023

Katherine Kelly Vidal
*Director of the United States Patent and Trademark Office*